(12) United States Patent
Delfour et al.

(10) Patent No.: US 8,116,987 B2
(45) Date of Patent: Feb. 14, 2012

(54) METHODS FOR THE IDENTIFICATION OF MICRORNA AND THEIR APPLICATIONS IN RESEARCH AND HUMAN HEALTH

(75) Inventors: Olivier Delfour, Toulouse (FR); Jerome Ciuti, Toulouse (FR); Florent Denoual, Toulouse (FR); David Vilanova, Toulouse (FR); Bernard Michot, Pern (FR)

(73) Assignee: Cepheid, Sunnyvale, CA (US)

( * ) Notice: Subject to any disclaimer, the term of this patent is extended or adjusted under 35 U.S.C. 154(b) by 592 days.

(21) Appl. No.: 12/092,952

(22) PCT Filed: Nov. 8, 2006

(86) PCT No.: PCT/EP2006/068246
§ 371 (c)(1),
(2), (4) Date: Sep. 11, 2008

(87) PCT Pub. No.: WO2007/054520
PCT Pub. Date: May 18, 2007

(65) Prior Publication Data
US 2009/0062135 A1 Mar. 5, 2009

(30) Foreign Application Priority Data
Nov. 8, 2005 (EP) .................................... 05292359

(51) Int. Cl.
*G01N 7/00* (2006.01)
(52) U.S. Cl. ................ 702/19; 702/20; 703/11; 703/12; 707/700; 536/24.5
(58) Field of Classification Search .................... 702/19, 702/20; 703/11, 12; 707/700; 536/24.5
See application file for complete search history.

(56) References Cited

OTHER PUBLICATIONS

Ng et al. Bioinformatics 2007 23 (11) 1321-1330.*
Bentwich, I. et al., "Identification of Hundreds of Conserved and Nonconserved Human MIcroRNAs," Jul. 2007, Nature Genetics, Nature America, vol. 37, No. 7, pp. 766-770.
Berezikov, Eugene et al., "Phylogenetic Shadowing of Computational Identification of Human MicroRNA Genes," Jan. 14, 2005, Cell, vol. 120, No. 1, pp. 21-24.
Grad Y. et al., "Computational and Experimental Identification of C. elegans MicroRNAs," May 1, 2003, Molecular Cell, Cell Press, vol. 11, No. 5, pp. 1253-1263.
Lai E. C. et al., "Computational Identification of Drosophila MicroRNA Genes," 2003, Genome Biology (Online), vol. 4, No. 7, p. R42, XP002370305.
Llave Cesar et al., "Endogenous and silencing-associated small RNAs in plants" Jul. 2002, Plant Cell, American Society of Plant Physiologists, Rockville, MD, US vol. 14, No. 7, pp. 1605-1619.
Sewer, Alain et al, "Identification of Clustered MicroRNAs Using an Ab Initio Prediction Method," Nov. 7, 2005, BMC Bioinformatics, vol. 6, pp. 1-15.
Smalheiser, Neil R., et al., "Mammalian MicroRNAs Derived from Genomic Repeats," Jun. 2005, vol. 21, No. 6, pp. 322-326, XP004911546.
Xie, Xiaohui et al., "Systematic Discovery of Regulatory Motifs in Human Promoters and 3' UTRs by Comparison of Several Mammals," Mar. 17, 2005, Nature, vol. 434, No. 7031, pp. 338-345.

* cited by examiner

*Primary Examiner* — Mary Zeman
(74) *Attorney, Agent, or Firm* — Kilpatrick Townsend & Stockton LLP

(57) ABSTRACT

The present invention concerns a method for prediction and identification of microRNA precursors (pre-microRNA) and microRNA molecules using data processing programs and databases. The invention also pertains to the isolated form of these pre-microRNAs, microRNA molecules and derived nucleic acids there of. The invention also relates to recombinant vector, host cell, support, pharmaceutical composition or kit comprising such microRNA molecules or there of derivated molecules. The invention also applies to the use of such microRNA molecules and/or their identified targets in research, prognostic, diagnostic tools/methods as well as for therapeutic applications.

29 Claims, 13 Drawing Sheets

True situation: 1 sequence in Human (query) has 3 occurrences in Mouse (hit)

3 blast report obtained (3HSPs)

```
5'      CAG       GA  A  GAGAA-       UU      C  A
   AUGG     AGAUAUU  CAU GU      AACA   GCCUU    A
   UACC     UCUGUAA  GUG CA      UUGU   CGGGA    C
3'      AGA       A-  A  AAACAG       UU      UAA
```

Secondary structure of SEQ ID 7805

```
5' G     -     AG    ACA  ACC         A------     UGCU
    CUGGCUCC UGCUC AGUG  GC  CUGUGG           GUC      G
    GACCGAGG ACGAG UCAC  CG  GACACC           CAG      G
3'       U     G-    CC-  A--         ACCAAUC     UCAU
```

Secondary structure of SEQ ID 7806

```
5' A       CAC-- --        UG         AU A  C   UU
    GUGGGGG     GU  UCAAGAA   CUAAUGA  U  U  AG   U
    UACCCUC     CG  AGUUCUU   GAUUACU  G  A  UU   U
3'        CAAAA AU        UA         CC A  U   C
```

Secondary structure of SEQ ID 7807

```
5'    C   C  - U  - -    C              - G
   GG UGG CAG GC CCGC CC CCGG  CCUCCCUGCGC  CC  G
   CC ACC GUC CG GGCG GG GGCU  GGAGGGACGCG  GG  C
3' C  -   C   A  - A  A  -              U  C
```

Secondary structure of SEQ ID 7808

```
5' C    A  A-  --            -----       AAC
    UCUCU CC  CCA  AAAUAAAUU        CAAUUACU   U
    AGAGA GG  GGU  UUUAUUUAA        GUUAAUGA   U
3'      C  GA  UC            UGGGC        -GU
```

Secondary structure of SEQ ID 7809

```
5'    - G         CAG    -  AAUG    AAG    G
   CAU GU AUUUCUGCC   UGCUC UG   UCA    UGAA  A
   GUA CA UGAGGGCGG   AUGGG AC   AGU    ACUU  A
3'    U A         CAA    C  GA--    A--    A
```

Secondary structure of SEQ ID 7810

FIG. 10

```
5'      G UA    U    U      AA         G U     C
   GCCU C  AUGG UCUAC GCUUUG  GGUUCCA G CUGUG -
   CGGA G  UGUC AGGUG UGAGGAC CCAGGGU U GACAC A
3'      G --    U    -      C-         G -     G
```

Secondary structure of SEQ ID 7811

```
5'          -       AAU  GU----     AA
   ACUUAG AGGAGUGACA    UUG     ACUUAAA A
   UGAAUC UCUUCACUGU    AAC     UGGAUUU U
3'          A       CCC  AAAAAU     -A
```

Secondary structure of SEQ ID 7812

```
5' C    CAG       AGCAAC       UA A--   -  AAA
   CCUCC    UUCCCAU    UGGGCUG GC   GC CAG   C
   GGAGG    AGGGGUG    GCCCGGU CG   CG GUU   U
3'    AA-      GAGUCA       GA ACC  A  AGU
```

Secondary structure of SEQ ID 7813

```
5'      U UGC    CUCU     GCC      UU    CA -UG
   GGAGA G  GCCCC    GCCAC   CCCACC  CCUGG GG  G
   CCUCU C  UGGGG    CGGUG   GGGUGG  GGACC CC  U
3'      - UU-    C---     AA-      UG    A- GGG
```

Secondary structure of SEQ ID 7814

```
5'    A UG   --   C-    A  C  -   U-
   CUU GGGG GGGG AGCC UGUU GCC UG UAAA  A
   GAG UCCC UCUC UCGG ACAA UGG GC AUUU  A
3'    -  UG   GG   UA    G  A  A   GA
```

Secondary structure of SEQ ID 7815

```
5'           C----     CA -    C     -  -CA
   AGUGCUUUU      UGUAA  GU CAUUUGA AUUUAAU AUAC   U
   UCACGAAAA      ACGUU  UA GUAAAUU UAAAUUA UAUG   A
3'           UCUUA     UA C    -     U  UUA
```

Secondary structure of SEQ ID 7816

FIG. 10 (continued)

```
5'      AA       G   GAUUAG  GU    CA    --    GA
   GUGAAG  UGCAGGCAG  UUGU       AG  GAGC  GUU   CCU  U
   CAUUUC  AUGUCCGUC  AAUA       UC  CUCG  UAA   GGG  U
3'      G-       A    A-----  GU    AA    UU    UG
```

Secondary structure of SEQ ID 7817

```
5'GCA          AA   C         U    -UGCU
     UCAUUAGCU  CA  AGGGAAAG  GAAA       G
     AGUAGUCGA  GU  UUCUUUUU  CUUU       U
3'--G          AC   C         -    UCAAU
```

Secondary structure of SEQ ID 7818

```
5'              C   A---        GA    --     CA
   CCUUUUGAGUGGA  CUG     AGGGUUUU  CCU   UCUU   G
   GGAG     UCACCU  GAC   UUCCAAAA  GGA   GGAA   G
3'         ---     U   AAAA        AC    AC     -A
```

Secondary structure of SEQ ID 7819

```
5'       --          UU  U  UCU  A  -   GAAA        -C
   CAUUUG  CUUGAUUAA  AC  GC   GA  ACC  CUU   ACAGA  A
   GUAGAC  GAGCUAAUU  UG  UG   CU  UGG  GAA   UGUCU  U
3'       AG          --  U--  A   U    ----        GG
```

Secondary structure of SEQ ID 7820

```
5'        AC    AG  -  -         G     ACG    AU
   GAGCUGC  AGAC  C  UG  CAAUUCAU  GGCG    CUG  U
   CUCGACG  UCUG  G  AC  GUUAGGUA  UCGC    GAC  G
3'        --    GG  U  G         -     AAA    -C
```

Secondary structure of SEQ ID 7821

FIG. 10 (continued)

METHODS FOR THE IDENTIFICATION OF MICRORNA AND THEIR APPLICATIONS IN RESEARCH AND HUMAN HEALTH

CROSS REFERENCE TO RELATED APPLICATIONS

This application is the U.S. National Stage entry of International Application No. PCT/US2006/068246, filed Nov. 8, 2006, which claims priority from and the benefit of European Application No. 05292359.6, filed on Nov. 8, 2005, the entire contents of both aforementioned applications are hereby incorporated herein by reference.

1. Field of the Invention

This invention generally relates to bioinformatics, and more particularly to the identification of RNA sequences, particularly microRNA precursor candidates.

2. Background of the Invention

The development of multi-cellular and multi-tissue organisms requires specific and coordinated control involving complex regulatory mechanisms that target every aspect of gene expression. NpcRNA (non protein coding ribonucleic acids) such as tRNA and rRNA are known essential regulators of gene expression and protein synthesis. MicroRNA (miRNA) constitute a vast family of non-protein coding RNA that play critical regulatory functions in numerous biological processes and hold the key of many important aspects of human health. For example, microRNAs orchestrate many aspects of cell, tissue and organism development. They also play key roles in the regulation of fundamental cellular mechanisms (Brennecke J and al., 3003; Chen C Z, 2004; Esau C and al., 2004; Yekta S, and al., 2004). Most microRNAs are submitted to two types of regulations: a temporal regulation which is a function of different cell growth stages, differentiation and development, and a spatial regulation. Indeed, they show specific expression patterns in each cellular or tissue type (Reinhart B J., 2000).

Besides the detection and profiling of miRNA genes, deciphering their function is also particularly challenging. With very few exceptions, their specific functions are unknown. MicroRNAs do not act alone, but act in combination to cooperatively regulate a definite biological process. This mode of action is the one generally referred to when talking about the so-called "microRNA code". The miRNAs that belong to a "functional family" need to be identified, and their "true" mRNA targets discerned from amongst thousands of possibilities. Being timely and spatially regulated, their discovery requires high-throughput methods, like microarrays, in order to find novel miRNAs, which are specifically expressed in particular cell-types, tissues and under different physiological conditions.

Additionally, the complete set of microRNA which are expressed in different organisms is unknown. Thus, one main challenge today consists in identifying the complete set of microRNAs. It appears that only the tip of the iceberg of the microRNA world is known. Contrary to what was believed for a long time, recent studies show that a great number of microRNA remain to be identified.

Today, it is a major challenge to identify novel microRNAs, and there is a growing interest of life science industries in microRNA. Indeed, the exhaustive knowledge of microRNA will make it possible to identify mechanisms of regulation, that will help to better understand the gene and protein regulation networks, and to discover new molecular biomarkers associated with cell development and many different diseases.

The principal method used until now to discover new microRNAs consists in their detection and their quantification by biological experiments using approaches and strategies of molecular biology, such as RNA extraction, amplification, cloning, gel electrophoresis, hybridization, and sequencing. However, the large majority of the microRNA are controlled in a space-time dependent manner, where they are mostly only slightly expressed. Thus, many escape detection by these conventional biochemical and genetic approaches.

Bioinformatic approaches have emerged as powerful alternatives. Predictive bioinformatics have provided many discoveries, obtained through combination of experimental and computational approaches. Nevertheless, these approaches require the development of new strategies. The identification of microRNA is indeed especially complex because of their very short size and their great variability in sequence. There is no evident specific sequence "signature" like for protein coding genes. The nature of their structural constraint is mainly defined by the complementarities with their mRNA targets, and not by any evident structural constraints within the mature miRNA itself. Thus, most of the computational methods are based on a search for their precursors, which fold into a variable and irregular stem-loop structures (hairpin secondary structures).

A first work in 2003 (Lim and al., 2003) led the authors to estimate the number of microRNA in the human genome to be 255. Actually, current works reveal that the number of microRNAs was considerably underestimated. Indeed, to date, 474 microRNAs are already referenced in the public data base Rfam, while other scientists (Grad, 2003; Krichevsky, 2003; Bentwich and al., 2005) suggests that the number of microRNA within the human genome could be at least 800.

In the human genome, only a few of the known microRNA are fully characterized. Thus, for the largest part of them one cannot associate a function: which gene, which messenger RNA or which proteins they control. The development of a systematic approach, associating bioinformatics predictions with experimental validations makes it possible to increase the known set of microRNA molecules. Their exploitation opens new ways to discover new key regulatory and functional molecules directly implied in pathologies and to conceive a new classes of therapeutic tools (for example: biomarkers, diagnostic/prognostic molecules and drugs).

However, new computational methods need to be developed to overcome the limitations of today's standard bioinformatics and laboratory tools.

BRIEF SUMMARY OF THE INVENTION

This invention provides methods for prediction and identification of microRNA precursors (pre-microRNA) and microRNA molecules using data processing programs and databases. The invention also pertains to the isolated form of these pre-microRNAs, microRNA molecules and derived nucleic acids thereof. The invention also relates to recombinant vector, host cell, support, pharmaceutical composition or kit comprising such microRNA molecules or there of derivated molecules. The invention also applies to the use of such microRNA molecules and/or their identified targets in research, prognostic, diagnostic tools/methods as well as for therapeutic applications.

The method of the present invention brings new and effective solutions to identify new microRNA, thus offering an effective and relevant solution to allow the discovery of new microRNA, undetectable with current methods. The method of the present invention was validated by an approach using microarrays, which enabled the confirmation of the expression of predicted microRNA in different tissues. Embodiments of the method of the present invention makes it possible to eliminate most of the false positive occurrences observed with other methods, and to increase the sensitivity in the search of new microRNA.

Accordingly, in a first aspect, the invention provides a computer-implemented method of identifying microRNA precursor candidates in non-coding and coding regions of a genome. In some embodiments, the methods comprise:

receiving at least a first and a second genome from two different species, each containing a plurality of sequences including highly repetitive DNA;

masking a first set of highly repetitive DNA sequences in the first genome, wherein the first set includes SINE and LINE interspersed repeat sequences, but does not include at least 75% of other interspersed repeat sequences;

masking a second set of highly repetitive DNA sequences in the second genome, wherein the second set includes SINE and LINE interspersed repeat sequences, but does not include at least 75% of the other interspersed repeat sequences;

comparing the masked first genome to the masked second genome to determine pairs of sequences that are homologous between the two genomes;

creating a list of microRNA precursor candidates from the homologous pairs; and analyzing the list of candidates to:

eliminate sequences having less than 60 nucleotides; and identify sequences that have a stem-loop secondary structure with a 5' strand stem having from 20 to 45 nucleotides and with a 3' strand stem having from 20 to 45 nucleotides; and remove, from the list, sequences not having said stem-loop secondary structure.

In one embodiment, the other interspersed repeat sequences include processed pseudogenes, retrotranscripts, DNA transposons, and retrovirus retrotransposons.

In one embodiment, the methods further comprise the steps of:

creating a plurality of assemblies, each created from at least one pair of homologous sequences, wherein at least one assembly is created from a first group of at least two pairs of homologous sequences, wherein each pair of the first group has one sequence in common;

clustering the assemblies into a plurality of clusters, wherein each assembly of a cluster shares at least one sequence with at least one other assembly of that cluster, wherein a cluster includes one or more assemblies;

analyzing the properties of each cluster to eliminate sequences from the list of candidates.

In one embodiment, the methods further comprise the steps of:

analyzing the properties of each cluster to determine new sequences from the clusters to be added to the first set and second set of sequences that are masked, further comprising:

adding the new sequences to the first set and to the second set; and repeating masking with the first set and to the second set, comparing the masked genomes, creating a plurality of assemblies, and clustering the assemblies.

In some embodiments, analyzing the properties of a cluster to determine new sequences comprises:

determining the number of sequences of a cluster; and if the number of sequences of a cluster is greater than a predetermined number, selecting the sequences of that cluster to be added to the first set and to the second set.

In some embodiments, at least one assembly is created from a second group of at least two pairs of homologous sequences, wherein the two sequences from the first genome of the second group overlap to form a first sequence, wherein the two sequences from the first genome of the second group overlap to form a second sequence, wherein the size variation between the first sequence and the second sequence is less than 10%, and wherein the alignment between the first sequence and the second sequence shows more than 85% sequence similarity.

In some embodiments, at least one assembly is created from a second group of at least two pairs of homologous sequences, wherein the two sequences from the first genome of the second group are consecutive and form a first sequence containing an intervening sequence, wherein the two sequences from the first genome of the second group are consecutive and form a second sequence containing an intervening sequence, wherein the size variation between the first sequence and the second sequence is less than 10%, and wherein the alignment between the first sequence and the second sequence shows more than 90% sequence similarity.

In some embodiments, analyzing the properties of a cluster includes:

if a cluster has more than a predetermined number of sequences, eliminating the sequences of that cluster from the list of candidates.

In some embodiments, the predetermined number is four.

In some embodiments, the predetermined number is three.

In some embodiments, analyzing the properties of the cluster further includes:

flagging sequences that correspond to a coding gene as 'coding';

eliminating all of the sequences of the cluster if one of the sequences is flagged as 'coding'; and eliminating the sequences of an assembly if the assembly is not identical by at least 85% within a minimal window of 60 nucleotides.

In some embodiments, analyzing comprises the steps of:

eliminating a pair of homologous sequences if a secondary structure resulting from a folding of the sequences does not satisfy each of a first set of criteria including:

a number of nucleotides in a pre-miRNA stem-loop;

a terminal hairpin being of a certain length;

a percentage similarity of the sequences between the two genomes; and a Z score less than a specified amount; and eliminating a pair of homologous sequences if a secondary structure resulting from a folding of the sequences does not satisfy a predetermined number of a second set of criteria including:

a minimal free energy (MFE) of less than a specified amount;

a GC content being within a certain percent range;

a base-paring number being within a certain percent range; and perfect conservation of a sequence of a specified length along arms of the stem-loop.

In some embodiments, the first set and the second set of criteria have the following values:

the pre-miRNA stem-loop is between 60 to 120 nucleotides;

the percentage similarity of the sequences between the two genomes is at least 85%;

at least one 17 nt-long sequence is perfectly conserved along the arms of the stem-loop;

the terminal hairpin-loop is between 4 and 15 nucleotides;

the GC content is from 30% to 51%;

the base-pairing number is between 30 and 40%;
the MFE is lower than −25 kcal/mol; and
the Z score is less than 0.06.

In some embodiments, analyzing further comprises:
when a sequence has a secondary structure satisfying the first set of criteria and a predetermined number of the second set of criteria, extracting exact positions of the 5' strand start and exact positions of the 3' strand end to make a new sequence;

folding the new sequence to from a new secondary structure; and parsing the secondary structure of the new structure to determine if the secondary structure satisfies the first set of criteria and a predetermined number of the second set of criteria.

In another aspect, the invention provides a computer-implemented method of identifying non coding RNA candidates. In some embodiments, the methods comprise:

receiving at least a first and a second genome from two different species, each containing a plurality of sequences including highly repetitive DNA;

masking a first set of highly repetitive DNA sequences in the first genome, wherein the first set includes SINE and LINE interspersed repeat sequences, but does not include at least 75% of other interspersed repeat sequences;

masking a second set of highly repetitive DNA sequences in the second genome, wherein the second set includes SINE and LINE interspersed repeat sequences, but does not include at least 75% of the other interspersed repeat sequences;

comparing the masked first genome to the masked second genome to determine pairs of sequences that are homologous between the two genomes;

creating a list of non coding RNA candidates from the homologous pairs;

creating a plurality of assemblies, each created from at least one pair of homologous sequences, wherein at least one assembly is created from a first group of at least two pairs of homologous sequences, wherein each pair of the first group has one sequence in common.

clustering the assemblies into a plurality of clusters, wherein each assembly of a cluster shares at least one sequence with at least one other assembly of that cluster, wherein a cluster includes one or more assemblies;

analyzing the properties of each cluster to eliminate sequences from the list of candidates;

analyzing the list of candidates to:
eliminate sequences having less than 60 nucleotides; and
identify sequences that have a stem-loop secondary structure with a 5' strand stem having from 20 to 45 nucleotides and with a 3' strand stem having from 20 to 45 nucleotides;
remove, from the list, sequences not having said stem-loop secondary structure;
eliminating a pair of homologous sequences if the secondary structure does not satisfy each of a first set of criteria; and
eliminating a pair of homologous sequences if the secondary structure does not satisfy a predetermined number of a second set of criteria;

In a further aspect, the invention provides methods of determining a list of sequences to mask from at least one genome. In some embodiments, the methods comprise:

receiving at least a first and a second genome from two different species, each containing a plurality of sequences including highly repetitive DNA;

comparing the masked first genome to the masked second genome to determine pairs of sequences that are homologous between the two genomes;

creating a plurality of assemblies, each created from at least one pair of homologous sequences, wherein at least one assembly is created from a first group of at least two pairs of homologous sequences, wherein each pair of the first group has one sequence in common.

clustering the assemblies into a plurality of clusters, wherein each assembly of a cluster shares at least one sequence with at least one other assembly of that cluster, wherein a cluster includes one or more assemblies;

analyzing the properties of each cluster to determine if the sequences of that cluster are to be added to the list of sequences to be masked.

In some embodiments, analyzing the clusters comprises:
determining the number of sequences of a cluster; and
if the number of sequences of a cluster is greater than a predetermined number, adding the sequences of that cluster to the list of sequences to be masked.

In some embodiments, the predetermined number is 1000.

In a related aspect, the invention provides solid supports comprising at least 5 pre-microRNA or microRNA nucleic acid capture sequences, wherein each of the capture sequences are at least 15 nucleotides in length and have sufficient sequence complementary to specifically capture a nucleic acid sequence selected from the group consisting of SEQ ID NOs: 1-7803, preferably 1-4004 and 4035-7803, and the complement thereof.

In some embodiments, the at least 5 capture sequences have 100% sequence complementarity to a nucleic acid sequence selected from the group consisting of SEQ ID NOs: 1-7803, preferably 1-4004 and 4035-7803, and the complements thereof.

In some embodiments, the at least 5 capture sequences have 100% sequence complementarity to the pre-microRNA selected from the group consisting of SEQ ID NOs: 3, 5, 16, 22, 32, 34, 35, 36, 60, 70, 77, 81, 82, 90, 93, 139, 141, 151, 152, 158, 163, 170, 175, 176, 183, 184, 191, 192, 200, 205, 219, 223, 224, 248, 275, 276, 323, 328, 344, 357, 363, 366, 385, 400, 406, 407, 425, 472, 481, 489, 500, 501, 503, 512, 527, 530, 531, 563, 608, 633, 640, 651, 653, 664, 678, 728, 744, 753, 784, 785, 786, 826, 832, 858, 876, 903, 909, 911, 926, 927, 940, 942, 944, 946, 947, 951, 955, 963, 967, 975, 1055, 1060, 1083, 1118, 1129, 1137, 1145, 1160, 1161, 1166, 1173, 1174, 1175, 1198, 1205, 1207, 1217, 1233, 1238, 1251, 1267, 1299, 1321, 1323, 1343, 1352, 1396, 1403, 1429, 1485, 1531, 1545, 1547, 1559, 1586, 1592, 1601, 1610, 1611, 1617, 1634, 1645, 1649, 1653, 1656, 1661, 1667, 1681, 1686, 1688, 1693, 4773 and the complements thereof.

In some embodiments, the at least 5 capture sequences have 100% sequence complementarity to the microRNA selected from the group consisting of SEQ ID NOs. 1697, 1698, 1700, 1719, 1720, 1730, 1731, 1732, 1744-1750, 1784, 1785, 1805-1807, 1815-1818, 1824-1828, 1837-1839, 1842, 1843, 1896-1900, 1911-1917, 1925, 1926, 1933, 1934, 1944, 1945, 1949-1954, 1959-1964, 1975-1979, 1990-1993, 2000-2002, 2025-2027, 2068, 2108, 2111, 2112, 2173-2175, 2180, 2181, 2201-2203, 2219-2221, 2228, 2229, 2231-2237, 2260, 2278-2280, 2313, 2314, 2408-2410, 2427-2434, 2437, 2438, 2532, 2450, 2451, 2469-2471, 2476, 2477, 2613, 2620-2622, 2637, 2648, 2679, 2730, 2754-2756, 2771, 2809, 2810, 2814, 2815, 2862, 2863, 2870-2872, 2900, 2958-2961, 2966-2968, 2971-2974, 2999-3001, 3015, 3017-3019, 3021, 3023-3027, 3029, 3030, 3038, 3039, 3048-3050, 3052-3054, 3061, 3062, 3162, 3189, 3232, 3233, 3249, 3250, 3271-3274, 3300-3304, 3320-3329, 3363, 3372-3375, 3378, 3379, 3391, 3392, 3416, 3417, 3422-3424, 3440-3442, 3461, 3497-3499, 3528, 3555-3557, 3567, 3619-3621, 3627, 3628, 3663, 3786, 3804-3808, 3862, 3863, 3870, 3871, 3896-3898, 3912, 3931, 3943, 3950, 3951, 3956, 3957, 3959, 3960, 3966-3968, 3973-3976, 3986, 3987, 3991-3994, 4001-4004, and the complements thereof.

In some embodiments, the at least 5 capture sequences have 100% sequence complementarity to the nucleic acid sequences selected from the group consisting of SEQ ID NOs: 4005-4034, and the complements thereof.

In some embodiments, the solid support is a nucleic acid array chip.

In a further aspect, the invention provides methods of detecting pre-microRNA or microRNA in a cell. In some embodiments, the methods comprise conducting multiplex polymerase chain reaction (PCR) to amplify at least 5 target pre microRNA or microRNA nucleic acid sequences using forward primers and reverse primers, wherein each forward and reverse primer pair member is substantially complementary to at least 15 contiguous nucleotides of a nucleic acid sequence selected from the group consisting of SEQ ID NOs: 1-7803, preferably 1-4004 and 4035-7803, and the complements thereof.

In some embodiments, the multiplex PCR methods comprise amplifying at least 5 pre-microRNA nucleic acid sequences selected from the group consisting of SEQ ID NOs: 1-1694 and 4035-5758.

In some embodiments, the multiplex PCR methods comprise amplifying at least 5 pre-microRNA nucleic acid sequences selected from the group consisting of SEQ ID NOs: 3, 5, 16, 22, 32, 34, 35, 36, 60, 70, 77, 81, 82, 90, 93, 139, 141, 151, 152, 158, 163, 170, 175, 176, 183, 184, 191, 192, 200, 205, 219, 223, 224, 248, 275, 276, 323, 328, 344, 357, 363, 366, 385, 400, 406, 407, 425, 472, 481, 489, 500, 501, 503, 512, 527, 530, 531, 563, 608, 633, 640, 651, 653, 664, 678, 728, 744, 753, 784, 785, 786, 826, 832, 858, 876, 903, 909, 911, 926, 927, 940, 942, 944, 946, 947, 951, 955, 963, 967, 975, 1055, 1060, 1083, 1118, 1129, 1137, 1145, 1160, 1161, 1166, 1173, 1174, 1175, 1198, 1205, 1207, 1217, 1233, 1238, 1251, 1267, 1299, 1321, 1323, 1343, 1352, 1396, 1403, 1429, 1485, 1531, 1545, 1547, 1559, 1586, 1592, 1601, 1610, 1611, 1617, 1634, 1645, 1649, 1653, 1656, 1661, 1667, 1681, 1686, 1688, 1693, 4773 and the complements thereof.

In some embodiments, the multiplex PCR methods comprise amplifying at least 5 microRNA nucleic acid sequences selected from the group consisting of SEQ ID NOs: 1695-4004 and 5759-7803.

In some embodiments, the multiplex PCR methods comprise amplifying at least 5 microRNA nucleic acid sequences selected from the group consisting of SEQ ID NOs. 1697, 1698, 1700, 1719, 1720, 1730, 1731, 1732, 1744-1750, 1784, 1785, 1805-1807, 1815-1818, 1824-1828, 1837-1839, 1842, 1843, 1896-1900, 1911-1917, 1925, 1926, 1933, 1934, 1944, 1945, 1949-1954, 1959-1964, 1975-1979, 1990-1993, 2000-2002, 2025-2027, 2068, 2108, 2111, 2112, 2173-2175, 2180, 2181, 2201-2203, 2219-2221, 2228, 2229, 2231-2237, 2260, 2278-2280, 2313, 2314, 2408-2410, 2427-2434, 2437, 2438, 2532, 2450, 2451, 2469-2471, 2476, 2477, 2613, 2620-2622, 2637, 2648, 2679, 2730, 2754-2756, 2771, 2809, 2810, 2814, 2815, 2862, 2863, 2870-2872, 2900, 2958-2961, 2966-2968, 2971-2974, 2999-3001, 3015, 3017-3019, 3021, 3023-3027, 3029, 3030, 3038, 3039, 3048-3050, 3052-3054, 3061, 3062, 3162, 3189, 3232, 3233, 3249, 3250, 3271-3274, 3300-3304, 3320-3329, 3363, 3372-3375, 3378, 3379, 3391, 3392, 3416, 3417, 3422-3424, 3440-3442, 3461, 3497-3499, 3528, 3555-3557, 3567, 3619-3621, 3627, 3628, 3663, 3786, 3804-3808, 3862, 3863, 3870, 3871, 3896-3898, 3912, 3931, 3943, 3950, 3951, 3956, 3957, 3959, 3960, 3966-3968, 3973-3976, 3986, 3987, 3991-3994, 4001-4004, and the complements thereof.

Definitions

The term processed "pseudogene", as used herein refers to non-functional DNA sequences created by the reverse transcription of mRNA into cDNA with subsequent reintegration into the genome. Typically, processed pseudogenes fall into three categories. 1) those that are a complete copy of the mRNA transcribed from the functional gene; 2) those that are only a partial copy of the mRNA transcribed from the functional gene; and 3) those that contain sequences in addition to sequences expected to be present in the mRNA transcribed from the functional gene.

General structural characteristics of processed pseudogenes include: 1) the complete lack of intervening sequences found in the functional gene (e.g. introns sequences); 2) a poly A tract located at the 3'-end of the sequence; 3) direct repeats flanking the pseudogene sequence; and 4) in most cases the pseudogene is located on a different chromosome from that of the functional gene. In identifying the processed pseudogenes, the computer compares the query sequence against a database comprised of genomic sequences which encode for the functional gene.

The term "DNA transposon" or "Class II transposons", as used herein refers to DNA sequences belonging to a class of mobile elements that are capable of transposing from one site in the genome to a new site in the genome. DNA transposons transpose directly through a DNA intermediate, rather than through an RNA intermediate. A defining feature of a DNA transposon is a sequence encoding for a protein required for transposition, having at least 95% sequence identity, or sequence identity based on the default setting, whichever is lower, to the transposase of bacterial insertional sequence elements. The sequence encoding the transposase-like protein is flanked on each end by a short (i.e., 4-15 bp) inverted repeat (IR) sequence, which are required for transposition. Each inverted repeat is flanked on its outside by a short (4-15 bp) direct repeat (DR) sequence (i.e. the 5'DR is 5' to the 5'IR). Another feature of DNA transposons is that they may contain introns as part of the intervening sequence between the inverted repeats, unlike retrotransposons.

The computer identifies DNA transposons by identifying sequences that contain the following elements in the 5' to 3' direction. 5'-DR-IR-(coding sequence for protein having at least 95% sequence identity to consensus sequence for known transposases)-IR-DR-3'. As mentioned above introns may or may not be present in the coding sequence and these will be identified by comparing the coding sequence with the genomic sequence of the functional gene.

The term "retrotransposons" or "Class I transposons", as used herein refer to mobile DNA elements that transpose through an RNA intermediate utilizing reverse transcriptase activity. Retrotransposons are subdivided into two classes. The first class are retrovirus retrotransposons (synonymous with LTR transposons) because they exhibit many similarities to the genomes of retroviruses. For example, they contain long terminal repeats (LTR) which are typically about 100 bp to about 1 kb in length that flank the 5' and 3' ends of the protein coding sequence of the LTR transposon. The computer identifies retrovirus retrotransposons by comparing the query sequence against a consensus LTR sequence derived from a database of known LTR sequences.

The second class of retrotransposons are non-retrovirus retrotransposons (synonymous with non-LTR retrotransposons) because they lack the characteristic LTRs. Non-LTR retrotransposons can be further subdivided into at least two subclasses, the most abundant being long interspersed elements (LINE) and short interspersed elements (SINE).

The term "LINE" as used herein refers to long (typically greater than 5 kb) DNA sequences that represent reverse transcribed RNA molecules that were originally transcribed by RNA polymerase II. A consensus LINE element is characterized as having the following structural features. First, LINE elements are typically greater than 5 kb in size and have at least two open reading frames. Typically, ORF1 is located near the 5' end of the top strand following a region containing multiple stop codons in all possible reading frames. ORF2 is located in the top strand 3' to ORF1, and encodes a protein having at least 95% sequence identity, or sequence identity of the default settings, whichever is lower, to the reverse transcriptases of retroviruses and viral retrotransposons. Flanking the 3'-end of ORF2 is an AT rich region. The entire LINE element is flanked by direct repeats at the 3' and 5' ends.

The computer searches for LINE elements by identifying regions greater than 5 kb flanked by direct repeats. The intervening sequence, as discussed above will contain a region having multiple stop codons in all frames, followed by one to four open reading frames, one of which will share 95% sequence identity, or sequence identity of the default settings, whichever is lower, with proteins similar to reverse transcriptases of retroviruses and viral retrotransposons. The 3' most ORF is flanked on its 3'-end by an AT rich region.

The term "SINE" as used herein refers to short DNA sequences (about 500 bp or less) that represent reverse transcribed RNA molecules that were originally transcribed by RNA polymerase III into tRNA, rRNA and other small nuclear RNAs. SINES do not encode a functional protein having reverse transcriptase activity. The most common SINES are Alu elements which are typically about 300 bp and do not contain any coding sequences and can be recognized by the restriction enzyme AluI.

Most SINE elements identified to date share the following common elements. A 5' tRNA, rRNA, or other small nuclear RNA related region (including A and B boxes for internal RNA polymerase III promoters), a tRNA, rRNA, or other small nuclear RNA unrelated region, and a 3' AT rich region, flanked on both the 3' and 5' ends by direct repeats.

The computer identifies SINE sequences by identifying sequences about 500 bp or less flanked by direct repeats. These sequences will be compared to a consensus sequences for tRNA, rRNA or other small nuclear RNAs compiled from a database of known RNA sequences. Sequences meeting this criteria will then be screened for an AT rich region 5' to the direct repeat located at the 3' end.

The term "retrotranscript" as used herein refers to the RNA intermediate of the retrotransposon.

The term "homologous pair" as used herein refers to any pair of sequences that have been identified as sharing ancestry. Any method and/or criteria may be used. For example, a percentage of similarity or identity may be used. In such an embodiment, no specific percentage is required, but simply that a percentage has been specified. In some embodiments, a homologous pair shares at least 80%, 85%, 90%, 93%, 95%, 97%, 99% or 100% sequence identity. In another embodiment, a homologous pair may be identified though an associative property between two other pairs, such as is done in clustering embodiments of the present invention.

As used interchangeably herein, the terms "nucleic acid", "oligonucleotides", and "polynucleotides" include RNA, DNA, or RNA/DNA hybrid sequences of more than one nucleotide in either single-stranded or double-stranded form. The term "nucleotide" as used herein as an adjective to describe molecules comprising RNA, DNA, or RNA/DNA hybrid sequences of any length. The term "nucleotide" is also used herein as a noun to refer to individual nucleotides or varieties of nucleotides, meaning a molecule, or individual unit in a larger nucleic acid molecule, comprising a purine or pyrimidine, a ribose or deoxyribose sugar moiety, and a phosphate group, or phosphodiester linkage in the case of nucleotides within an oligonucleotide or polynucleotide. Although the term "nucleotide" is also used herein to encompass "modified nucleotides" which comprise at least one modifications (a) an alternative linking group, (b) an analogous form of purine, (c) an analogous form of pyrimidine, or (d) an analogous sugar. However, the polynucleotides of the invention are preferably comprised of greater than 50% conventional deoxyribose nucleotides, and most preferably greater than 90% conventional deoxyribose nucleotides. The nucleic acids of the invention may be prepared by any known method, including synthetic, recombinant, ex vivo generation, or a combination thereof, as well as utilizing any purification methods known in the art.

As used herein, the term "isolated" requires that the material be removed from its original environment (e.g., the natural environment if it is naturally occurring). For example, a naturally-occurring nucleic acid in a living animal is not isolated, but the same nucleic acid, separated from some or all of the coexisting materials in the natural system, is isolated. Such nucleic acid could be part of a vector and/or such nucleic acid could be part of a composition, and still be isolated in that the vector or composition is not part of its natural environment.

The phrases "selectively (or specifically) hybridizes to" or "selectively (or specifically) capture" interchangeably refer to the binding, duplexing, or hybridizing of a molecule only to a particular nucleotide sequence under stringent hybridization conditions when that sequence is present in a complex mixture (e.g., total cellular or library DNA or RNA). Typically, specific or selective binding will be at least twice background signal or noise and more typically more than 10 to 100 times background.

The terms "complementary" or "complement thereof" are used herein to refer to the sequences of a nucleic acid which are capable of forming Watson & Crick base pairing with another specified nucleic acid throughout the entirety of the complementary region. This term is applied to pairs of nucleic acid based solely upon their sequences and not any particular set of conditions under which the two polynucleotides would actually bind.

As used herein, the terms "complementary" or "complement" interchangeably refer to 100% antisense sequence identity.

The terms "sufficiently complementary" or "substantially complementary" interchangeably refer to antisense sequence identity between two nucleic acid sequences sufficient for hybridization under stringent hybridization conditions. Two nucleic acid sequences that are sufficiently complementary share at least 93% antisense sequence identity (i.e., 1 mismatched nucleotide over a length of 15 nucleotides). In some embodiments, sufficiently complementary nucleic acid sequences share at least 94%, 95%, 96%, 97%, 98% or 99% antisense sequence identity.

As used herein, the term "hybridizes to" is intended to describe conditions for moderate stringency or high stringency hybridization, preferably where the hybridization and washing conditions permit nucleotide sequences at least 60% identity to each other to remain hybridized to each other. Preferably, the conditions are such that sequences at least about 80%, 85%, 90%, 93%, 95%, 97%, 98%, 99% sequence identity to each other typically remain hybridized to each other. Stringent conditions are known to those skilled in the art and can be found in Ausubel, *Current Protocols in*

*Molecular Biology,* 2006, supra. A preferred, non-limiting example of stringent hybridization conditions are as follows: the hybridization step is realized at 65° C. in the presence of 6×SSC buffer, 5× Denhardt's solution, 0.5% SDS and 100 μg/ml of salmon sperm DNA. The hybridization step is followed by four washing steps:

two washings during 5 min, preferably at 65° C. in a 2×SSC and 0.1% SDS buffer;
one washing during 30 min, preferably at 65° C. in a 2×SSC and 0.1% SDS buffer;
one washing during 10 min, preferably at 65° C. in a 0.1×SSC and 0.1% SDS buffer, these hybridization conditions being suitable for a nucleic acid molecule of about 20 nucleotides in length. It will be appreciated that the hybridization conditions described above are to be adapted according to the length of the desired nucleic acid, following techniques well known to the one skilled in the art, for example be adapted according to the teachings disclosed in Hames B. D. and Higgins S. J. (1985) Nucleic Acid Hybridization: A Practical Approach. Hames and Higgins Ed., IRL Press, Oxford; and Current Protocols in Molecular Biolog (supra). Preferably, an isolated nucleic acid molecule of the invention that hybridizes under stringent conditions to a sequence of SEQ ID No 1 or 2 or 3 corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein).

As used herein, "percent sequence identity" between two nucleic acid sequences is intended to indicate a percentage of nucleotides between the two sequences to be compared, obtained after the best alignment (optimum alignment), this percentage being purely statistical and the differences between the two sequences being distributed randomly and over their entire length. The comparisons of sequences between two nucleic acid are traditionally carried out by comparing these sequences after having aligned them in an optimum manner, said comparison can be carried out, in addition to manually, by means of the local homology algorithm of Smith and Waterman (1981) [Ad. App. Math. 2:482], by means of the local homology algorithm of Neddleman and Wunsch (1970) [J. Mol. Biol. 48: 443], by means of the similarity search method of Pearson and Lipman (1988) [Proc. Natl. Acad. Sci. USA 85:2444), by means of computer software using these algorithms (GAP, BESTFIT, FASTA and TFASTA in the Wisconsin Genetics Software Package, Genetics Computer Group, 575 Science Dr., Madison, Wis., or else by BLAST N or BLAST P comparison software).

The percentage of identity between two nucleic acid sequences is determined by comparing these two sequences aligned in an optimum manner and in which the nucleic acid to be compared can comprise additions or deletions with respect to the reference sequence for an optimum alignment between these two sequences. The percentage of identity is calculated by determining the number of identical positions for which the nucleotide is identical between the two sequences, by dividing this number of identical positions by the total number of positions in the comparison window and by multiplying the result obtained by 100 in order to obtain the percentage of identity between these two sequences.

For example, one can use the BLAST program, "BLAST 2 sequences" (Tatusova et al., "Blast 2 sequences—a new tool for comparing protein and nucleotide sequences", FEMS Microbiol Lett. 174:247-250) available on the site http://www.ncbi.nlm.nih.gov/gorf/bl2.html, the parameters used being those given by default (in particular for the parameters "open gap penalty": 5, and "extension gap penalty": 2; the matrix chosen being, for example, the matrix "BLOSUM 62" proposed by the program), the percentage of identity between the two sequences to be compared being calculated directly by the program.

By a nucleic sequence having at least 80%, 85%, 90%, 91%, 92%, 93%, 94%, 95%, 96%, 97%, 98%, 99% sequence identity with a reference nucleic acid sequence, those having, with respect to the reference sequence, certain modifications, for example, a deletion, addition or substitution of at least one nucleotide, a truncation or an elongation. In the case of a substitution, it may be one or more consecutive or non-consecutive nucleotide(s).

General or current methods/protocols in molecular biology can be particularly found in the following references:
a) Sambrook and Russell, Molecular Cloning: A Laboratory Manual, 2001, Cold Spring Harbor Laboratory Press.
b) Bowtell and Sambrook, DNA Microarrays: A Molecular Cloning Manual, 2003, Cold Spring Harbor Laboratory Press.
c) Ausubel, et al., Current Protocols in Molecular Biology, 1987-2006, John Wiley Interscience.
d) Stirling and Bartlett, PCR Protocols, 2003, Humana Press.

BRIEF DESCRIPTION OF THE DRAWINGS

FIG. 10 illustrates secondary structures of select sequences (SEQ ID NOs: 7805-7821) according to one embodiment of the present invention.

DETAILED DESCRIPTION

Figure 1:
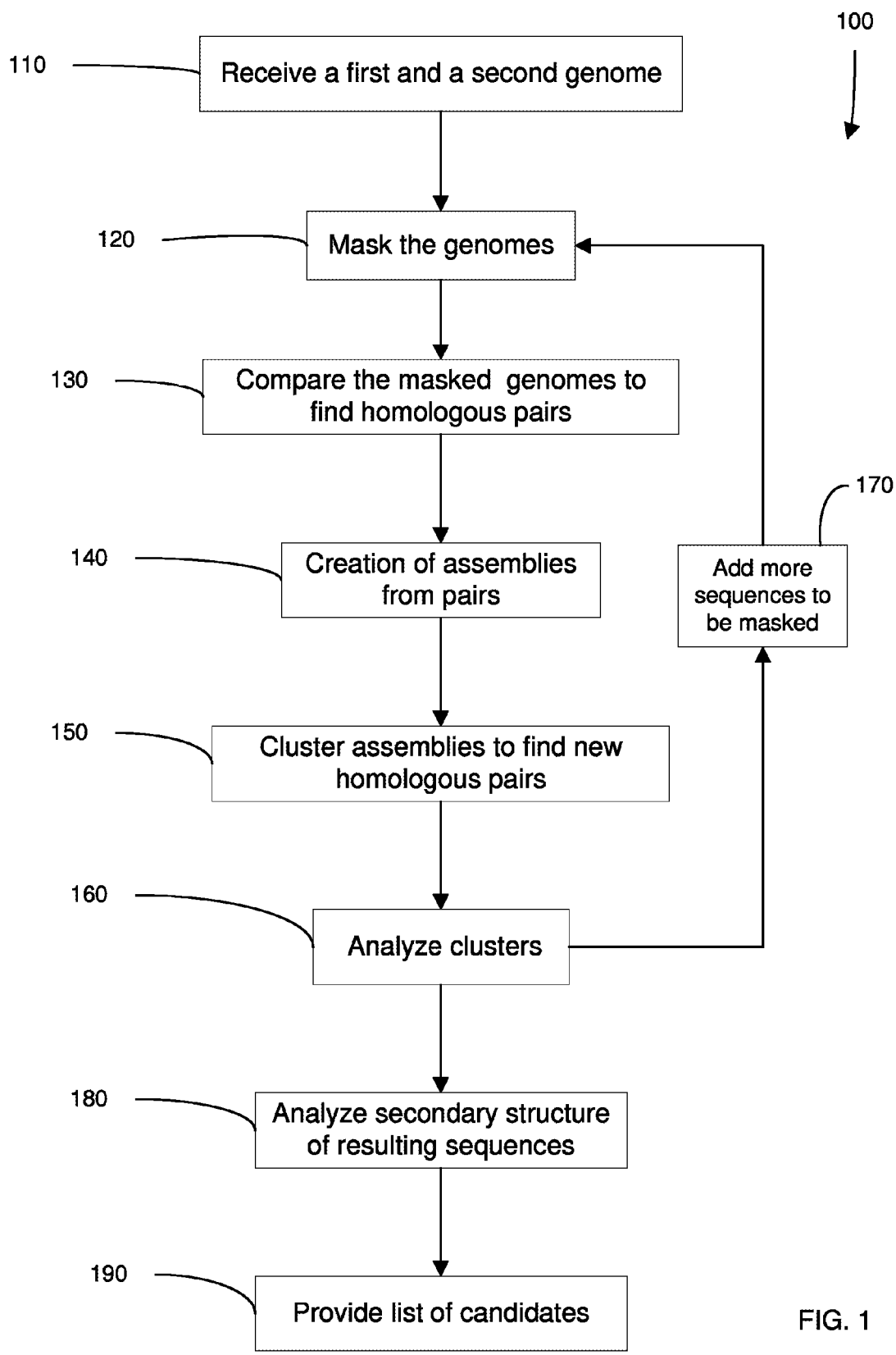
FIG. 1 illustrates a method of identifying microRNA precursor candidates in non-coding and coding regions of a genome according to an embodiment of the present invention.

This invention provides methods of identifying potential non-coding RNA, particularly microRNA precursor (pre-miRNA) candidates. In one embodiment, pre-miRNA are searched in homologous sequence pairs obtained from comparative genomics. In one aspect, to find more pre-miRNA, a different set of sequences are masked from the genomes than which is normally done. In some embodiments, the sequence pairs may be combined into assemblies and clustered to find new homologous relationships, which through analysis provide new techniques for discovering pre-miRNA. In another aspect, specific combinations of criteria and folding mechanism may be further used to determine pre-miRNA. Although, embodiments are directed to methods of finding microRNA precursor candidates, one skilled in the art will appreciate that embodiments may be used to find other non-coding RNA candidates.

I. Introduction

NpcRNA (non protein coding ribonucleic acids) such as tRNA and rRNA are known essentials regulators of gene expression and protein synthesis. MicroRNA constitute a vast family of non-protein coding RNA. These microRNA are very short in length. In the human genome their size generally varies between 17 nucleotides (for example: miR-138 and miR-496) and 25 nucleotides (for example miR-519a-1, miR519a-2). With very few exceptions, their functions are unknown.

The microRNA (or miRNA) can be processed in two different ways. In the first way of biosynthesis, the microRNA is encoded by its endogenous gene, and is transcribed as a long primary precursor called pri-microRNA (or pri-miRNA) (review Nelson et al 2003, Bartel 2004). In mammals, this pri-microRNA is cleaved by the nuclease Drosha (Lee and al., 2003) to give a precursor of approximately 60-120 nucleotides length, which is called the pre-microRNA (or pre-miRNA). This precursor folds into a short and irregular stem-loop secondary structure. The pre-microRNA is then exported by the enzyme exportin-5 to the cytoplasm of the cells (Yi and al., 2003; Lund et al. 2004; Bohnsack and al., 2004). The Dicer nuclease then cuts out the mature microRNA from the pre-microRNA (Hutvagner and al., 2001; Ketting and al., 2001; Knight and Bass 2001; Grishok and al., 2001). The mature microRNA are bound to a set of proteins, to the family of Argonaute proteins and the proteins Gemin3 and Gemin4 (most frequently in human cells), to form micro-Ribonucleoprotein complexes, called microRNP (or miRNP) (Mourelatos and al., 2002; Nelson and al., 2004).

In the second way of biosynthesis, the microRNA can be produced from introns of protein-coding genes. In this case, there is direct production of the pre-microRNA. Following maturation, steps remain common.

An essential characteristic of microRNAs are their antisense capability. The microRNAs function through more or less extended base-pairings with the 3'UTR region of specific messenger RNAs (Target Sequences of Recognition or TSR). According to the localization and the extent of complementarity (partial or complete), a microRNA will exert, either a repression of translation of this mRNA, or destruction of the messenger RNA target. In the latter case, an endonucleolytic cleavage occurs, which requires the intervention of an enzymatic complex called RISC(RNA-induced silencing complex).

MicroRNAs are involved in the cascades of events leading to cell differentiation. They control various metabolic pathways and physiological processes such as cell proliferation or cell apoptosis (Houbaviy H B., and al. 2003; He L and Hannon G J., 2004; Kasashima K, and al., 2004; Xu P., and al., 2004; Bartel P., 2004). Thus, microRNAs orchestrate many aspects of cell, tissue and organism development. They play key roles in the regulation of fundamental cellular mechanisms (Brennecke J and al., 3003; Chen C Z, 2004; Esau C and al., 2004; Yekta S, and al., 2004).

Specifically, there is now an accumulation of evidence demonstrating the direct role of microRNA in the development of pathologies, such as cancers. In the adenocarcinoma of the lung, a reduction of the expression of the microRNA let-7 is associated with a significant shortening of post-operational survival, while an over-expression of this same microRNA in a cellular line (A549) of adenocarcinoma of the lung inhibits the growth of the cancerous cells in vitro (Takamizawa J and al., 2004).

A strong expression of the precursor of the microRNA-155/BIC in the lymphoma of Burkitt was observed (Metzler Mr. and al., 2003). Two microRNAs (miR-143 and miR-145), which are conserved between human and mouse genomes, show substantial reduction of accumulation in definite stages of colorectal cancers (Michael M Z., 2003).

Deletion and decrease of expression of the microRNA miR15 and miR16 occur in the majority (approximately 68%) of leukemias of the "B cell chronic lymphocytic leukemia" type (Calin G A. and al., 2002; Calin G A. and al., 2004). These two microRNAs are localised on the chromosome 13q14, an area of 30-KB which is deleted in more than half of these leukemias. Also, it has been demonstrated that the microRNA mir-17-92 family is over-expressed in human lymphomas (He L, 2005). Moreover, an over-expression of the very same microRNAs results in a cancer in mice.

Recently, a direct link was established for the first time between microRNA and c-Myc, a proto-oncogene which encodes for a transcription factor and regulates cellular proliferation, cell growth and apoptosis (O' Donnel K A, 2005). The c-Myc simultaneously activates the transcription of the transcription factor E2F1 and the expression of 6 microRNAs, 2 of which (miR-17-5p and miR-20a) repress the expression of E2F1, thus allowing a fine control of the signals controlling cell proliferation.

MicroRNA are also involved in neurological and neurodegenerative diseases (Dostie, Z and al., 2003) and the brain expresses a great number of specific microRNAs (Kim J and al., 2004; Krichevsky AMNDT and al., 2004; Kubawara T and al., 2004); Miska E A. and al., 2004; Sempere L F. and al., 2004).

The metabolic diseases also involve microRNAs. Recently, it was shown that a microRNA (miR-375), specific to the pancreatic small islet-specific cells, controls insulin secretion. Thus, miR-375 is a regulator of the secretion of insulin and could constitute a new pharmaceutical target for the treatment of diabetes (Poy M N, and al., 2004).

MicroRNAs act through networks of interactions. Higher organism requires two levels of programming: on the one hand specification of the functional component (primarily the proteome) and on the other hand the orchestration of the expression and the assembly of these components during the stages of differentiation and development. MicroRNA, which interact with mRNA and proteins, determine how, when and where genes must be expressed. These regulations take place in a coordinated network with one microRNA regulating the expression of several different genes post-transcriptionally and one gene being regulated by several different microRNA. These interactions are imbricated, function on several levels and allow a precise adjustment, in real time, of expression/regulation of a specific set of proteins in a cell. Playing a central role in mechanisms of regulation essential for the development and the integrity of the cellular and tissue organization of organism, microRNAs multiply the possibilities of regulation and challenge our vision of the networks of interactions between gene products (Mattick J S., 2003).

Biological experiments show that changes in this network architecture are as significant as variations in the proteome components for the determination of cells differences, but also certainly determinant for the differences between species and individuals. MicroRNA expression is sensitive to environmental parameters, and has a differential susceptibility for pathologies.

The implication of the microRNA in the mechanisms responsible for the gene activation/inactivation results in changes of the protein expression profiles and therefore allows the change of the cell status, that is development and differentiation within a physiological context. However, due to this capacity, aberrant microRNA expression can lead to major changes in protein expression profiles resulting in the development of specific pathologies.

It is now acquired that the microRNA, similar to transcription factors, act in a co-operative dose-dependent manner upon their mRNA targets. Experimental results show that specific gene expression profiles of different tissues can be explained by the "microRNA code" (Hobert O., 2004; Doench J G and Sharp Pa., 2004) which relates to the specific set of microRNA expressed within different tissues.

In a general way, a set of microRNA is necessary to control the same mRNA. At the same time, a microRNA can have several different messenger RNA targets. This multiplicity of the targets and the co-operative aspect of the signals are essential features of the control of translation by microRNAs (Enright A J and al., 2003; John B and al., 2004).

MicroRNAs inhibit expression of protein-coding genes either without affecting the concentration of the targeted mRNA, or by decreasing its concentration (Lim L P and al., 2005). In vertebrates, 20 to 30% of the protein coding genes are supposed to be controlled by microRNAs (Lewis L P and al., 2005; Krek A and al., 2005; Xie X et al., 2005).

II. Methods of Identifying MICRORNA Precursor Candidates

In a first aspect, the present invention is directed to a computer-implemented method for the identification of candidate microRNA precursor molecules (pre-microRNAs). FIG. 1 illustrates a method 100 of identifying microRNA precursor candidates in non-coding and coding regions of a genome according to an embodiment of the present invention. These steps may be rearranged to be performed in a different order, and some steps may be removed. A general description of the method and these steps is initially provided. Subsequent sections provide greater detail of these specific steps and of some embodiments.

In step 110, at least two genomes are received. Any two genomes may be used and more than two genomes may be received. In one embodiment, the genomes are the *Homo Sapien* (human) genome and the *Mus Musculus* (mouse) genome. In other embodiments, the genomes may be from plants or any other living organism. In step 120, the received genomes are masked using a library of sequences. This masking reduces the amount of the genome that has to be analyzed, but does not reduce the amount of genome to be analyzed as to exclude significant portions of the genome that might include microRNAs.

In step 130, the genomes are compared, e.g., using BLAST, to determine pairs of sequences that are homologous between the two genomes. Any percentage of sequence similarity or identity may be used to define homology. In some embodiments, homologous pairs share at least 80%, 85%, 90%, 93%, 95%, 97%, 99% or 100% sequence identity. These homologues pairs may be used to create a list of microRNAs precursor candidates. In step 140, certain homologous pairs are combined into assemblies, for example, through filtering of coding sequences and optimisation of the data. In step 150, the assemblies are clustered, thereby, finding new homologous pairs of sequences.

In step 160, the clusters are analyzed. In one aspect, the sequences of certain clusters are removed from a list of microRNAs precursor candidates. In another aspect, the sequences of certain clusters are identified for being added to the library of sequences to be masked. Thus, in one embodiment, in step 170, these sequences are added to the library. At this point, steps 120-160 may be repeated as needed with the results from using the new library for masking in step 120. In step 180, the sequences remaining in the list of candidates are analyzed to determine if their secondary structure satisfies certain combination of criteria. In step 190, list of microRNAs precursor candidates is provided.

A. Masking the Genomes

A wide part of vertebrate genomes consists of stretches of highly repetitive DNA sequences classified into five categories: simple repeats, tandem repeats, segmental duplications and interspersed repeats. To avoid a tremendous number of spurious matches in whole genome comparisons or analyses, these low-complexity regions are "masked" by replacing corresponding nucleotides by another character, such "N" or "X" or a lowercase character of the same type. Typically, not only are highly repetitive sequences masked, but also pseudogenes, non-functional copies of RNA genes, small RNA pseudogenes and all active small RNAs.

Currently, almost 50% of the human genome is annotated as belonging to these classes, and is masked accordingly by the standard RepBase library. This masking of the genome has been designed for a more accurate and sensitive analysis of genomic regions directly related to the expression of coding genes. Accordingly, research has been focused on the coding part of the genomes, applying strong masking criteria and filtering out what they called <<junk DNA >>. Thus, most of these genomes lack non-coding RNA genes, mainly because the masking applied to the comparison has cleaned them out. With regards to finding microRNA, the result is that too much of the genome is masked out and removed from further analysis. When masking involves a comparison of an unknown sequence to a list of known sequences such as a list of transposons, retrotransposons or pseudogenes, the decision to mask or not to mask is made at the default settings of the software or at a 95% sequence identity level, which ever is lower, with a word size of 8, e-value of 1 and a penalty of −1 for one mismatch, unless otherwise stated.

Accordingly, in one embodiment, to find more microRNAs, non-processed pseudogenes, unitary pseudogenes, non-functional copies of RNA genes, non-protein coding RNAs, small RNA pseudogenes, snRNAs, snoRNA, and all active small RNAs are selectively or in combination not masked in appreciable numbers. This results in at least 75% of this group of sequences not being masked.

In another embodiment, only certain interspersed repeat sequences are masked, and an appreciable number of other interspersed repeat sequences are not masked. For example, the masking is restricted to an appreciable number of SINE and LINE interspersed repeated sequences, but not other interspersed repeat sequences, thus allowing this previously inaccessible part of the genome to be analyzed. In one aspect, the appreciable number of SINE and LINE sequences that are masked is from 75% to 100% of commonly attributed SINE and LINE sequences. In another aspect, an appreciable number of the other interspersed repeat sequences not being masked results in at least 75% of these other interspersed repeat sequences not being masked. In another aspect, the other interspersed repeat sequences, which are not masked, include one or more of processed pseudogenes, retrotranscripts, DNA transposons, and retrovirus retrotransposons.

In one embodiment, the sequences which are not included in the masking library are interspersed repeated sequences other than SINE and LINE, but also other non-coding RNA. For example, all non-functional genes (such as pseudogenes and small RNAs), which are normally included in the "available masking files", are not included in the masking file of an embodiment of the present invention.

Therefore, embodiments of the present invention have investigated about 20% of mostly unexplored human and mouse genome sequences (about 500 millions nucleotides located in non-coding regions never analyzed by others). Thus, subsequent steps of comparing two masked genomes, analyzing secondary structure, and identifying highly conserved areas in the secondary structure can find previously hidden microRNA precursor molecules.

In one embodiment, BLAST is used with a set (library) of repeat sequences as defined for one of the embodiments being used as the database and the genome defined as query. Other sequence alignment tools and software may be used. The result from BLAST provides where the sequences of the library appear in the genome. These found sequences can then be removed or replaced with 'X'. For example, xblast.pl may parse the results and remove sequence repeats, replace the sequences with 'X', replace the sequences with lower case letters, or replace the sequences with any other character.

In one aspect, this methodology of using a library of sequences to be masked allows for much more precision as only the sequences included in the library are masked. In contrast, RepeatMasker extends in 5' and 3' the sequences contained in their library. This results in a large masking around each sequence of the library.

B. Comparing the Two Masked Genomes

The masked genomes are compared to determine pairs of sequences that are homologous between the two genomes. In one embodiment, an alignment algorithm is used to identify between the two genomes a pair of sequences that have a sufficient percentage of similarity (identity).

In one embodiment, each genomic comparison was performed using mpiBLAST (Darling et al., The Design, Implementation, and Evaluation of mpiBLAST), that is an implementation of the ncbi Blast (Karlin, Altschul PNAS 87:2264-2268, 1990) allowing the use of a cluster of computer in a Massive Parallel Interface (MPI) language. In one aspect, four dual processor computers were used with another computer running as master controller for all the jobs.

BLAST calculates all segment-pairs between the query and the database sequences that present sequence similarity above a scoring threshold. The result is a list of high-scoring pairs (HSPs). Each HSP is a pair of sub-sequences of the same length that form an ungapped alignment. The number of HSPs found depends of the parameters set for running BLAST. In particular, BLAST will report only those sequences whose scores are over some cutoff score. In one embodiment, the BLAST parameters used were: e-value: 0.01; and word size: 11. However, any parameters and any percentage of sequence similarity or identity may be used to define homology. In some embodiments, homologous pairs share at least 80%, 85%, 90%, 93%, 95%, 97%, 99% or 100% sequence identity.

One genome may be used for making queries to the other genome, which is used as the database. In one embodiment, the masked *Homo sapiens* genome was used as the query and the masked *Mus musculus* genome was used as the database. In one aspect, MySQL was used as the database environment. In this embodiment, computing took about 6.5 days to compare the *Homo sapiens* genome (as query) and the *Mus musculus* genome (defined as database). The sequence used as query (*Homo sapiens*) was split in chunks of 100000 base pairs (bp) with an overlap of 3000 bp. This was done to increase the speed of the comparison and to avoid overloaded computer memory.

In one aspect, the homology coordinates between the query and the hit are stored in a database. The coordinates are defined as a High Scoring Pair (HSP as defined by BLAST). Each HSP is defined by a start, an end and a strand on each genome. In one embodiment, a total of over 1 million HSPs were obtained at the end of this step. These homologues pairs may be used to create a list of microRNA precursor candidates.

Since BLAST relies on heuristic procedures, it is not guaranteed to find the best matches. Also, BLAST produces only binary relationships between one sequence of genome 1 and one sequence of genome 2. Thus, some of them can be missed, in particular when long sequences are compared (such as two mammalian genomes). In our case, both the Query sequence (human genome) and the Database (mouse genome) are very long. Thus, in one embodiment, the parameters are set in order to increase the predictiveness to avoid false positive. A direct consequence is a decrease in sensitivity, i.e. the loss of true positives.

C. Creation of Assemblies from Homologous Pairs

The creation of "assemblies" can generally be achieved by two different processes. In filtering, two HSPs that overlap or are successive are combined. In optimization, HSPs that share the same sequence are collapsed into the same entry.

Filtering reduces the number of HSP (potentially over one million) by assembling the HSPs into large sequences, which are one form of an "assembly". In view to (1) avoid potential overlaps between HSP and (2) have a more realistic view of sequence homologies between the genomes compared, a unique record integrates those HSP which sequences are either overlapping or consecutive in the two genomes. These assembled HSPs are included within the term "assemblies".

Figure 2A:
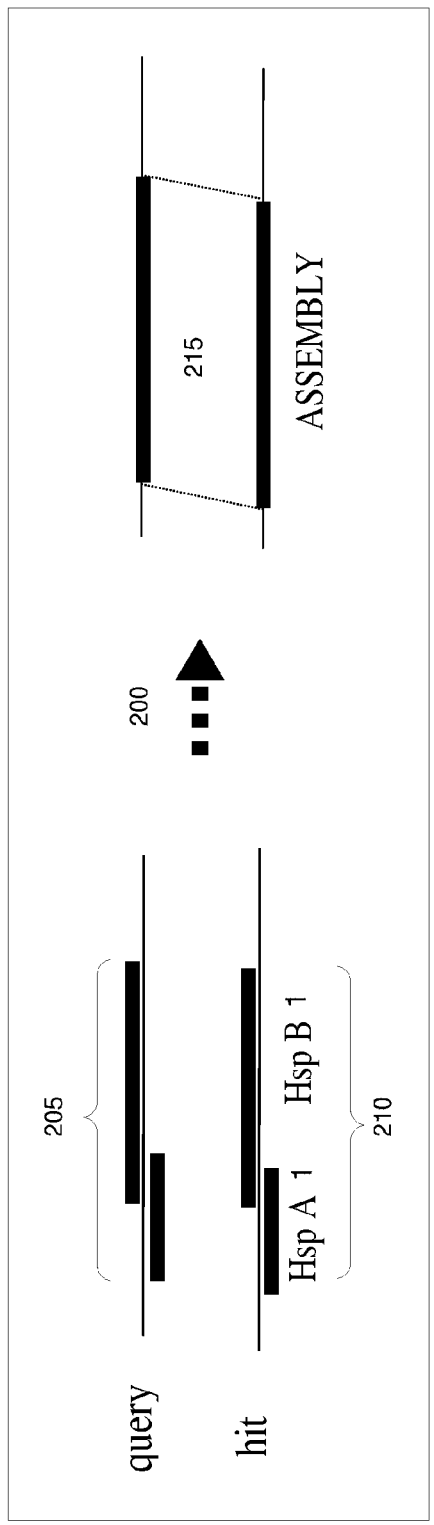
FIG. 2A illustrates an assembling process of creating an "assembly" by filtering according to one embodiment of the present invention.

FIG. 2A illustrates an assembling process 200 of creating an "assembly" by filtering according to one embodiment of the present invention. In process 200, if two or more HSPs share the same query and hit genomic sequence in terms of genomic position, then a new 'HSP' is built and an "assembly" is created. For example, HSP A1 and HSP B1 share the same query sequence 205 and hit sequence 210. Thus, they are combined into assembly 215.

Figure 2B:
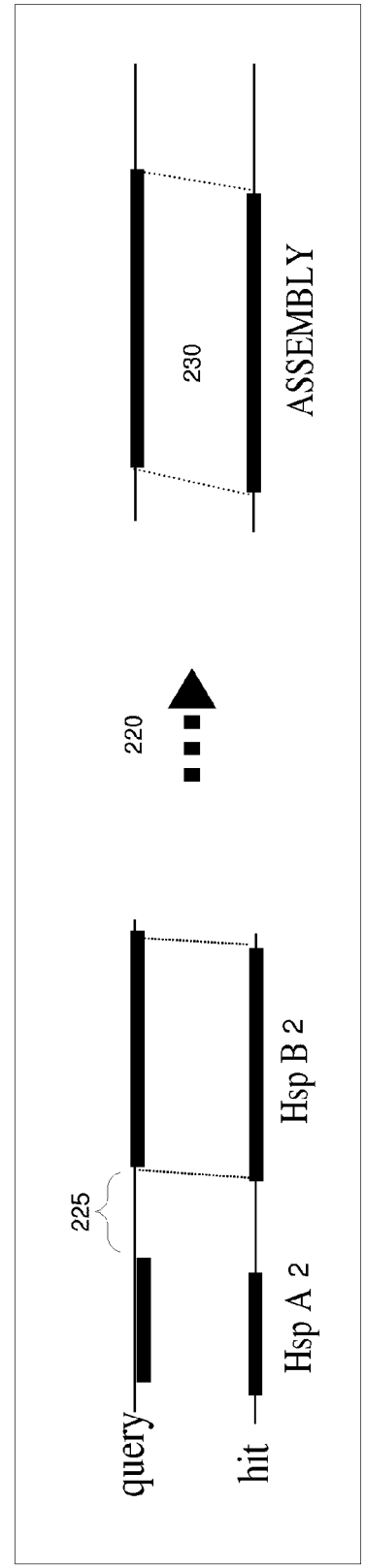
FIG. 2B illustrates another assembling process of creating an "assembly" by filtering according to one embodiment of the present invention.

FIG. 2B illustrates another assembling process 220 of creating an "assembly" by filtering according to one embodiment of the present invention. In process 220, if two queries and two hits coming from two HSPs share the same chromosome and have a distance which is similar, then a new 'HSP' is built and an "assembly" is created. For example, HSP A2 and HSP B2 share the same chromosome and have a distance 225 which is similar. Thus, they are combined into assembly 230. So, an assembly may be defined by a start, an end, a chromosome, a strand on the query and on the hit, and an internal identifier in the database.

Therefore, an assembly created by filtering is a set of HSPs that follow certain rules. In one embodiment, for the two genomes (species) included in the comparison, the size variation between two sequences of two consecutive HSP is less than 10%, and the resulting alignment including the two HSPs plus the intervening sequence must show more than 90% sequence similarity.

An "assembly" may also be created by optimization. Optimization avoids redundancies in the database, as "query" sequences having many "hits" are grouped in only one entry. When making a BLAST run, if a sequence defined as a query is present many times in the database, the results will give a report with the number of HSPs being equal to the number of times the sequence is present in the database. HSPs with the above characteristic are grouped into an "assembly". This means all the "hits" will then refer to one "query" in the database, which are then marked with an integer. This step makes it possible to reflect the situation in the genome and to make a data compression of at least 29%.

Figure 2C:
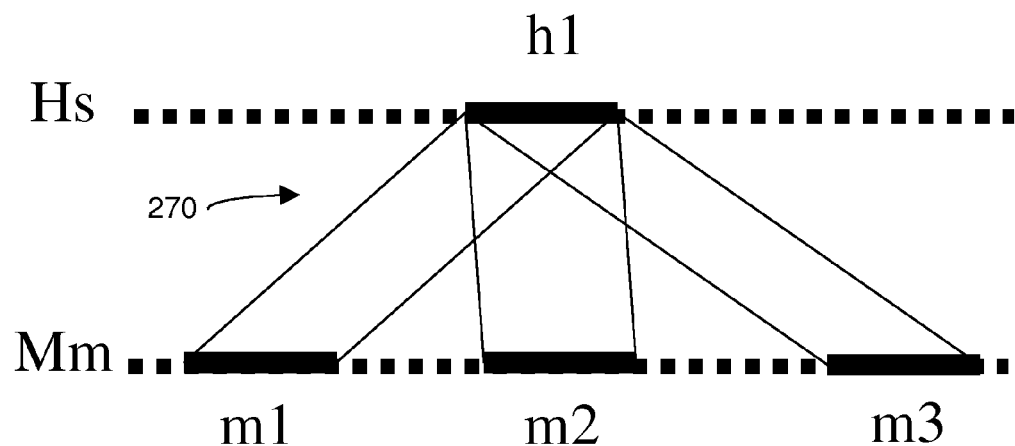
FIG. 2C illustrates an assembling process of creating an "assembly" by optimization according to one embodiment of the present invention.
Figure 2C:
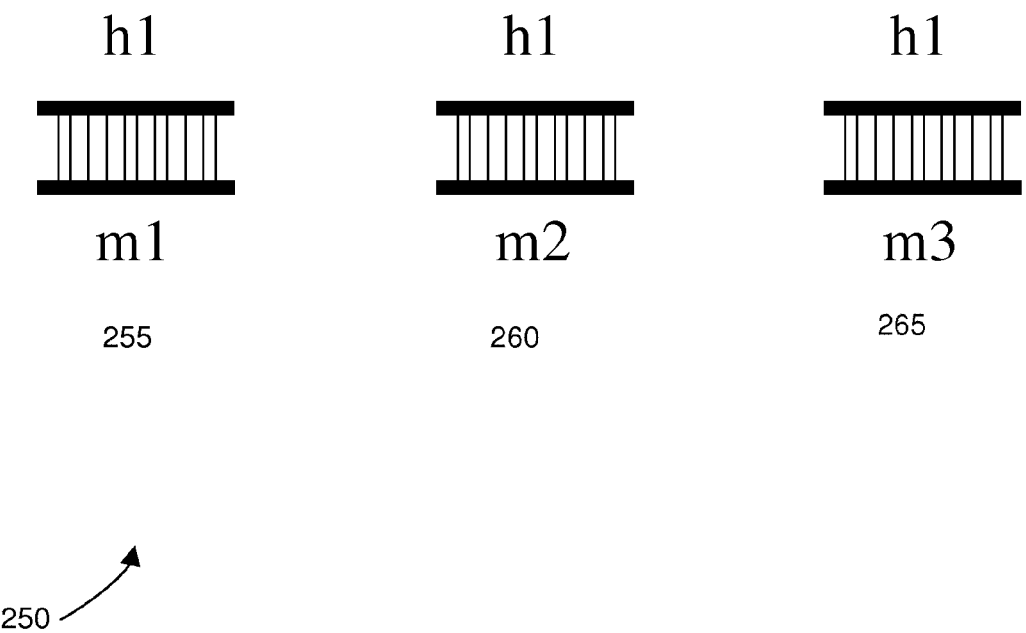

FIG. 2C illustrates an assembling process 250 of creating an "assembly" by optimization according to one embodiment of the present invention. Three BLAST reports obtained three HSPs 255-265. Each HSP 255-265 has sequence "h1" as the query. Thus, process 250 combines HSPs 255-265 into "assembly" 270.

Thus, after this step, the list of homologous sequences is recorded either in HSPs or assemblies. Each homologous pair of sequences (HSP or assembly) is recorded with exactly the same information. An assembly may be defined by the resulting file containing the mix of HSPs and "assembled HSP" from the filtering process. An "assembly" also includes HSPs that have not been combined with other HSPs. For example, in instances, where filtering and optimization does not apply to an HSP, then that HSP would be considered an assembly.

Thus, in one embodiment, an assembly is defined by: an identifier, for both human and mouse genomes a chromosome, a start, an end, a strand. One query sequence (with a chromosome, a start, an end, a strand) may belong to many "assemblies". One hit sequence (with a chromosome, a start, an end, a strand) may also belong to many "assemblies".

D. Clustering of Homologous Sequences

In order to reduce the background noise due to the genomic comparison and to filter sequences that are over represented in the two genomes, a clustering method is applied to cluster assemblies with homologous sequence but different genomic positions. In one aspect, the background noise comes from the fact that the BLAST parameters are chosen for increasing predicteness. Thus, very few false positive homologous sequences are obtained, but some true positive ones are lost. A subsequent clustering of assemblies allows finding undetected true positives.

Each assembly record contains an alignment of the two sequences identified as "homologous" by BLAST. This homology is, in particular, dependent on the degree of similarity between the two sequences. Each sequence within an assembly is defined by its coordinates (5' end, 3' end) along the genome, the genomic strand (plus or minus) and the chromosome number. The coordinates (5' end and 3' end, strand and chromosome identification) of the sequences for all assemblies are scanned. In one embodiment, assemblies are clustered together if each assembly of a cluster contains one sequence (either query or database) which has exactly the same coordinate (5' end and 3' end, strand and chromosome identification) as at least one other assembly of the cluster. The underlying assumption is: if A is homologous to B and A is homologous to C, then B and C are homologous, which potentially has been missed by BLAST. This is term an associative property of homologous pairs.

Figure 3:
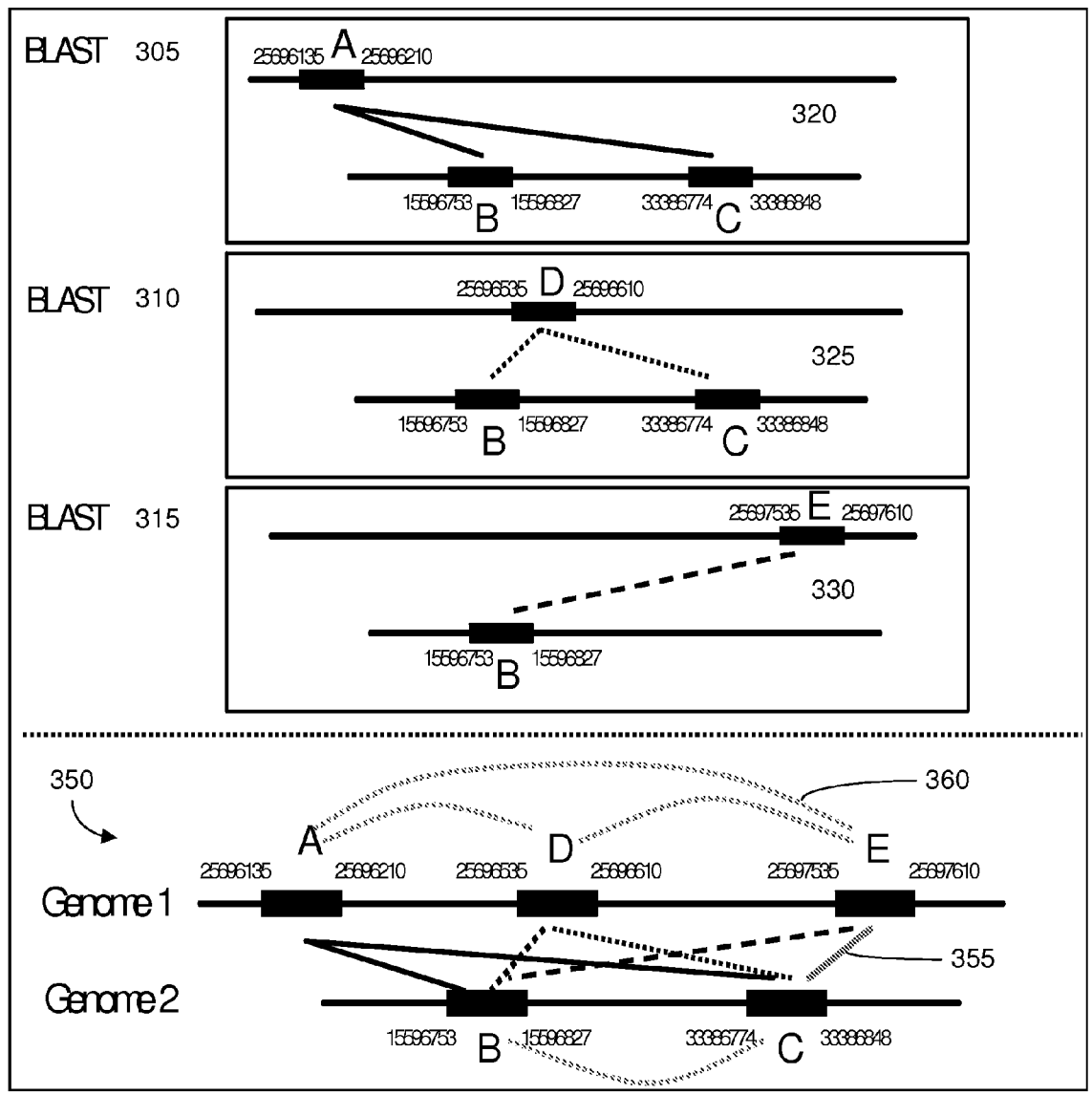
FIG. 3 illustrates a cluster created according to an embodiment of the present invention.

FIG. 3 illustrates a cluster 350 created according to an embodiment of the present invention. Three BLAST reports 305-315 provide three different assemblies 320-335. These assemblies 320-335 are combined into cluster 350 by a clustering process that tests if at least one sequence of an assembly is shared with at least one other assembly of a cluster. In this example, there is even more sharing as each assembly shares sequence B. In this manner, new homologous relationships are found.

For example, sequences E and C, which are not seen as homologous by BLAST report 315 are actually related as shown by their very high sequence similarity with the other sequences of this cluster. This homology of an orthologous type is signified by the new relationship 355. Also, sequences A, D, and E are homologous to each other. This homology of a paralogous type is signified by relationships 360. Each line in FIG. 3 signifies a homologous relationship, and each sequence in a cluster has a homologous relationship with every other sequence of that cluster.

Despite working on coordinates of homologous sequences detected by BLAST, an embodiment clusters together only sequences which have evident homologous relationships (high similarity rate). This is one of advantages of such a clustering method according an embodiment of the present invention. In one aspect, appropriate SQL syntax and Perl scripts are used to cluster "assemblies" that share at least one sequence (sequence hit or sequence query) with at least one other "assembly" of the cluster.

Figure 4:
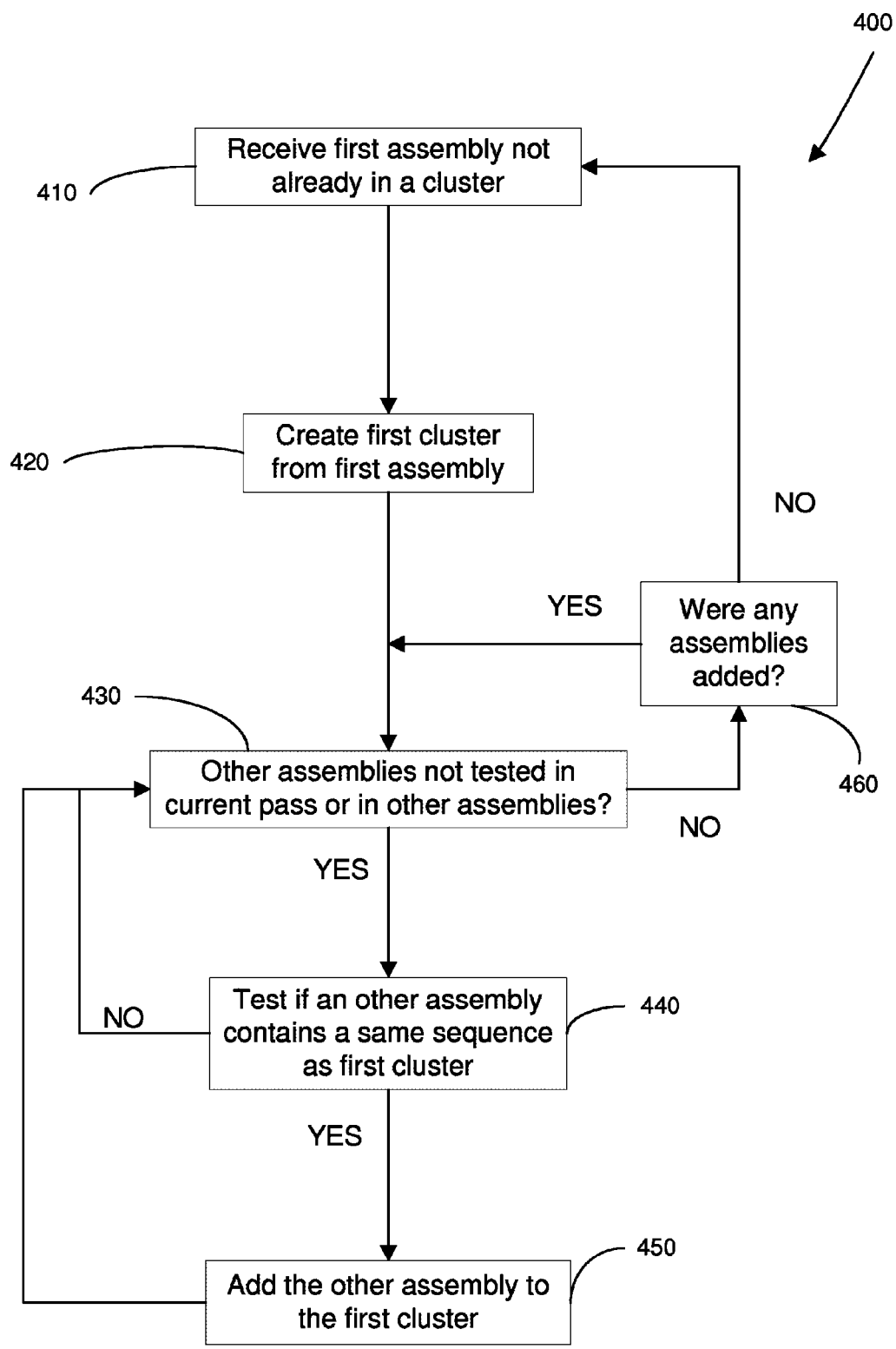
FIG. 4 illustrates a method of clustering assemblies according to an embodiment of the present invention.

FIG. 4 illustrates a method 400 of clustering assemblies according to an embodiment of the present invention. In step 410, a first assembly is received. In step 420, a cluster is created from the first assembly. At this point, the cluster and assembly are identical as no other assemblies have yet been added. In step 430, it is determined if other assemblies have not been tested. In one aspect, it is also determined if other assemblies do not already belong to a cluster.

If there is another assembly, in step 440, the other assembly is tested whether the assembly contains a sequence in the first cluster. If the other assembly does not contain a sequence that is within the first cluster, then the process reverts back to step 430 to determine if there are any other assemblies to be tested. If the other assembly does contain a sequence that is within the first cluster, then the sequences of that assembly are added to the first cluster. Once the assemblies are exhausted, the method moves form step 430 to step 460, which determines if any assemblies have been added to the first cluster in the current pass through the assemblies. If an assembly has been added in the current pass, then another pass of testing the assemblies is made. If no assemblies have been added, then method 400 repeats for the remaining assemblies not already in a cluster by receiving one of them and starting a new cluster. One skilled in the art will appreciate other methods for performing the clustering according to the rule that at least one sequence of an assembly is shared with at least one other assembly of a cluster.

Figure 5:
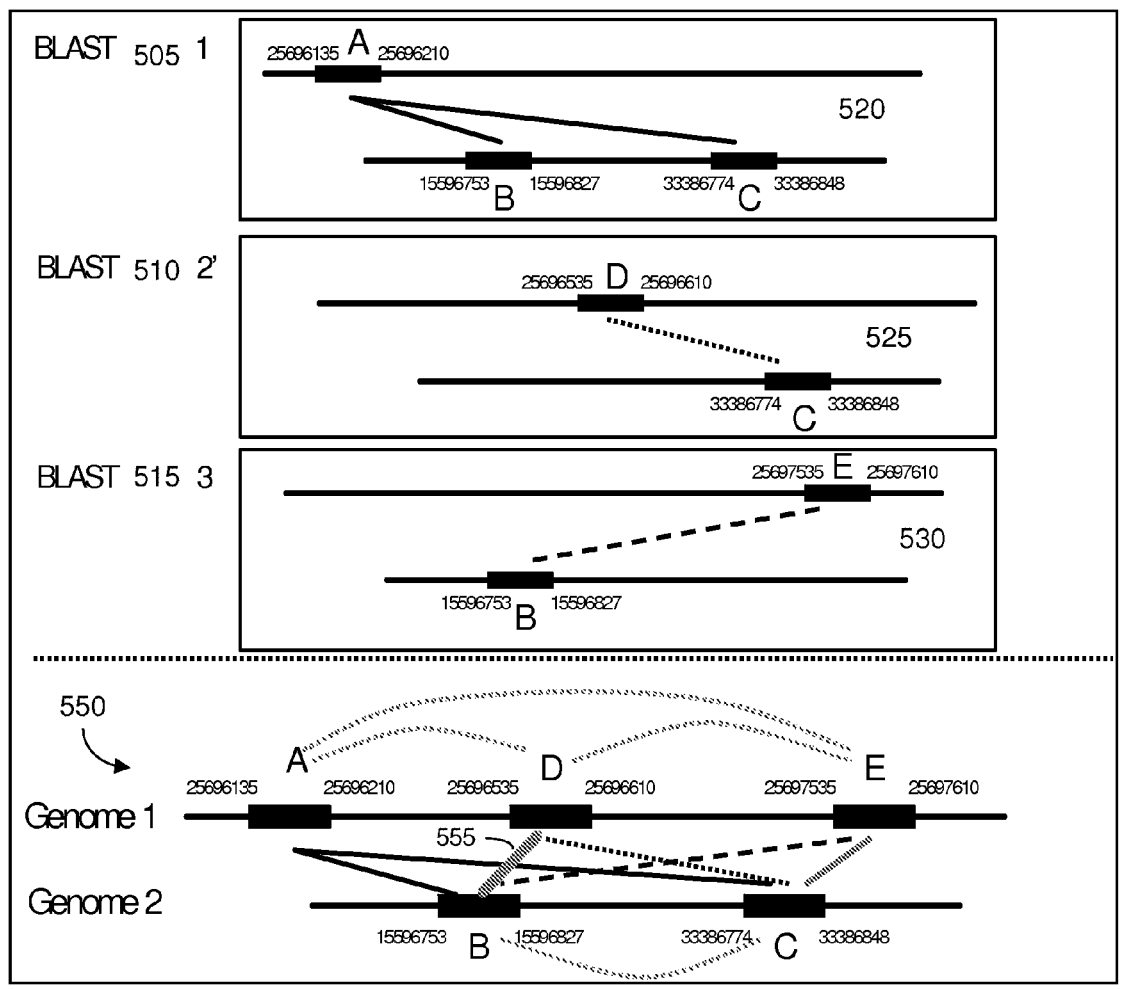
FIG. 5 illustrates a cluster created according to an embodiment of the present invention.

FIG. 5 illustrates a cluster 550 created according to an embodiment of the present invention. Three BLAST reports 505-515 provide three different assemblies 520-535. These assemblies 520-535 are combined into cluster 550 by a clustering process, which tests if at least one sequence of an assembly is shared with at least one other assembly of a cluster, e.g. method 400. In this example, BLAST report 510 has not shown a homologous relationship between sequence D and B. However, since assembly 520 and assembly 525 both share sequence C, cluster 550 contains both D and B, thus deeming them to have a homologous relationship 555, which is of the orthologous type to be precise.

In one embodiment of using method 400, the first assembly received (410) is the assembly 520 of sequences A, B, and C. In step 420, cluster 550 is formed from assembly 520. In step 430, it is determined that assemblies 525 and 530 have not been tested. Control then moves to step 440, where assembly 525 is tested if assembly 525 contains a sequence in common with the sequences of cluster 550, which at this point are sequences A, B, and C. Since assembly 525 shares sequence C with cluster 550, sequence D is added to cluster 550, in step 450. Then upon returning to step 430, it is determined that assembly 530 has not been tested. At step 440, sequence B is determined to be shared between assembly 530 and cluster 550. Thus, at step 450, sequence E is added to cluster 550.

If there were other assemblies that were not added to cluster 550, then these remaining assemblies would be clustered in a similar procedure. In one aspect, another pass at the remaining assemblies is done to determine if any of them share sequences with assemblies (effectively then entire cluster) that were added to the cluster after that assembly was tested. This may be needed to ensure that a cluster has all assemblies of the genome that are homologous within one cluster. Continued passes over the remaining assemblies may be performed until no more assemblies are added. At that point, a new cluster may be created from one of the remaining assemblies, and method 400 may be repeated for that cluster.

Thus, in one embodiment, a cluster is created as a set of "assemblies" that are homologous in sequence. In one aspect, a cluster is referenced by an identifier which refers to the set of identifiers for each of the assembly of the cluster. In another aspect, a cluster is also referenced by the number of homologous sequences (links) that a cluster contains from the organisms that have been used for the comparative genomics. The number of links for each cluster is then stored in the database, along with the corresponding assemblies.

In one aspect, this clustering method allows grouping of paralogous sequences and orthologous sequences together. Paralogous sequences are sequences that have diverged from a common ancestral sequence. Orthologous sequences are sequences that have evolved directly from an ancestral sequence. According to this clustering method, the number of times a sequence is present in the genomes is known, and specifically the number of times a sequence is present in the query genome and how many times the same sequence is present in the database sequence is known.

The initial BLAST comparison is based on the similarities between the sequences to identify homology relationships. In one aspect, our clustering method allows to group together all the sequences of both genomes which are homologous, between the two genomes. In addition, this clustering step allows identifying all the paralogous sequences within each genome. The underlying tenet is a systematic reference to homology relationships between sequences of the two genomes compared by BLAST.

In another aspect, this clustering method allows increasing the sensitivity of the BLAST result without increasing the number of false positive. The clustering method can identify homology relationships not detected by BLAST. The predictiveness of BLAST results is consequently also considerably increased.

E. Analyzing Clusters

1. Selecting Sequences to Add to Masking Library

In one embodiment, the clustering of assemblies was also used to identify new highly repeated sequences. These new repeat sequences may be added to the masking library, as described in step 170 of FIG. 1. These new repeat sequences may be determined from the clusters of assemblies. In one aspect, these new repeat sequences are taken from clusters that have a large number of sequences within that cluster. For example, clusters having more than 1000 sequences may be identified as being highly repetitive and are added to the masking library. In other embodiments, the required number of sequences may be as low as 500.

In one embodiment, 1200 different clusters having more than 1000 sequences were identified. In one aspect, for each cluster, one sequence is sufficient to define a cluster. Thus, one new repeat sequence may be added to the masking library for each cluster having a sufficient number of sequences.

Then, as was previously done in step 120 of FIG. 1, BLAST is used to mask each genome with these new sequences.

2. Annotation of the Conserved Non-Coding DNA

In one embodiment, to predict non-coding genes and in particular microRNA genes, all the coding regions as defined by an official genome annotation are flagged in order to exclude them for future predictions.

Using a database of the "assemblies" and knowing the exact position of the sequence corresponding to the query (e.g., human genome) and using human annotation provided by Ensembl on the same genome, the exact position of the query sequence which does not code for a protein with a 'non-coding' flag is stored in the database. Thus, in one aspect, the coordinates of each query sequence, which is conserved, are used to define whether sequence is part of a coding gene or not. All the conserved regions are then flagged 'coding' when they correspond to a coding gene. Then, the coordinates for the non-coding part of the conserved query genome are stored in a database.

Figure 6:
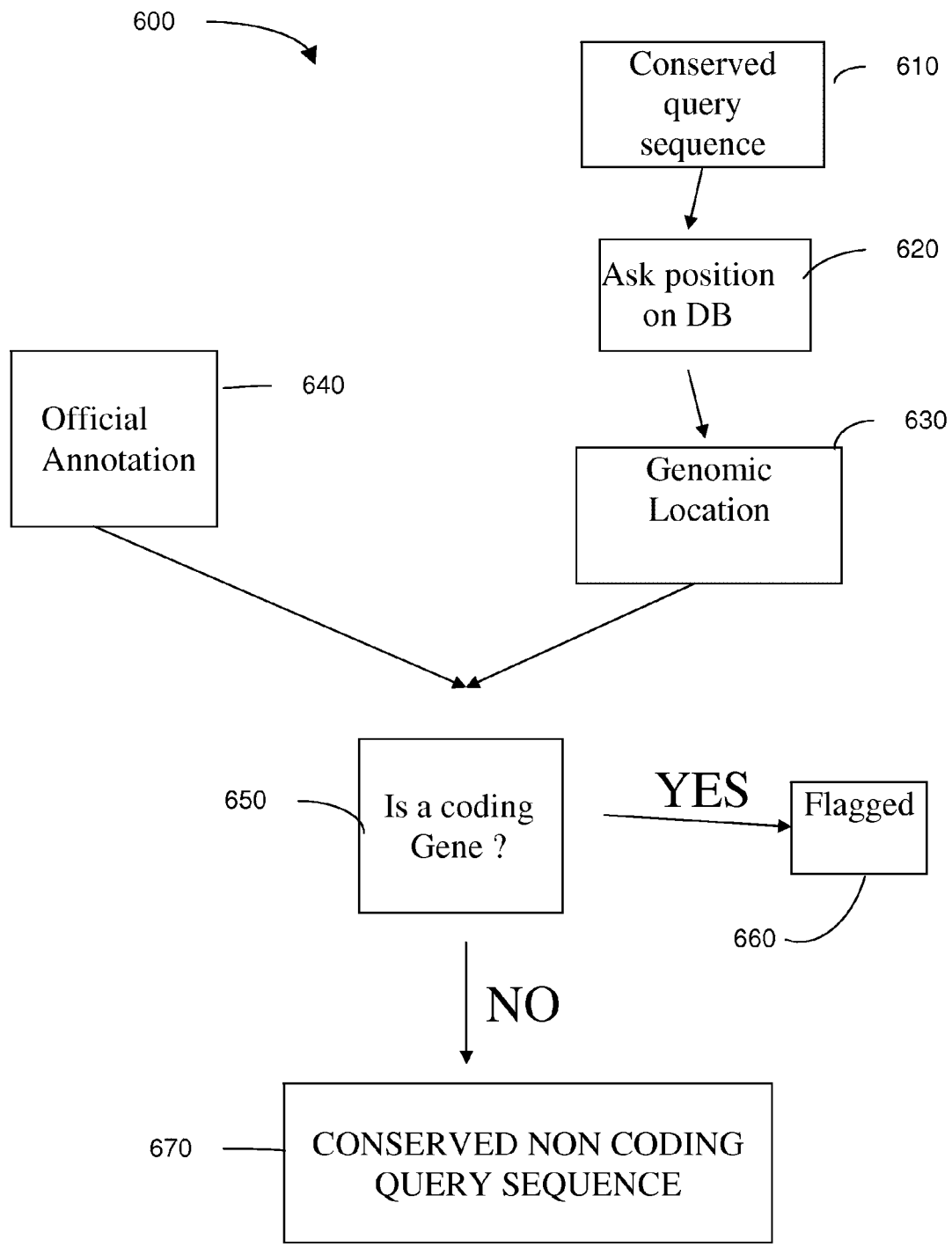
FIG. 6 illustrates a method of annotating the sequences of assemblies as containing coding or non-coding DNA according to an embodiment of the present invention.

FIG. 6 illustrates a method 600 of annotating the sequences of assemblies as containing coding or non-coding DNA. In step 610, conserved query sequences are taken from the sequences of the assemblies belonging to one of the genomes, e.g., the query genome. In step 620, the positions of the sequences are obtained from the database. In step 630, the genomic location of the sequence is determined from the positions. In step 650, these sequences are compared to the official annotation 640 to determine if a gene is coding or not. In step 660, if the gene is coding then the sequence is flagged as coding. In step 670, if the sequence does not contain a coding gene then it is determined to be a conserved non-coding query sequence.

3. Elimination of Assemblies and Clusters

In one embodiment, the sequences of the clusters are analyzed in order to eliminate one or more of the sequences as microRNA precursor candidates. In one aspect, one or more of the following characteristics are used to eliminate sequences. MicroRNA are: (1) present as only a relatively low number or less of copies in one genome, e.g., about 6 per genome, which results in about 12 per cluster when two genomes are used; (2) flagged as non-coding; (3) at least 60 nucleotides (nt) in length under the form of their precursor; and (4) conserved with at least 85% identity between two genomes, such as *Homo sapiens* and *Mus musculus*. In one embodiment, only the length characteristic is used.

Figure 7:
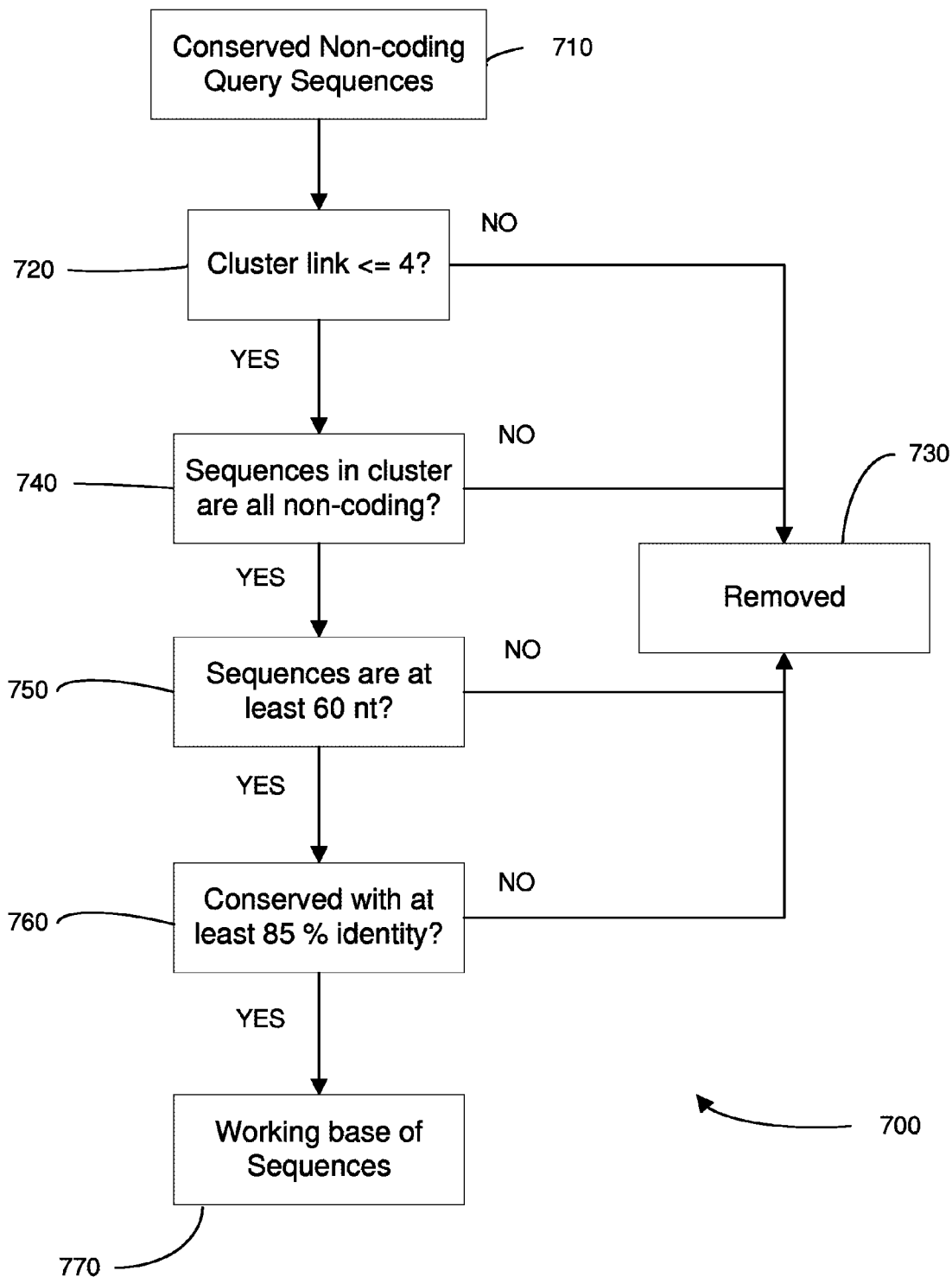
FIG. 7 illustrates a method of eliminating sequences of assemblies and clusters according to an embodiment of the present invention.

FIG. 7 illustrates a method 700 of eliminating sequences of assemblies and clusters according to an embodiment of the present invention. In step 720, non-coding sequences 710 based on the query annotations are checked to see if they are in a cluster with less than or equal to a certain number of homologous sequences (links). For example, if four links is used, then a sequence is checked to determine if the sequence is in a cluster with no more than 2 hits and no more than 2 queries. If a cluster satisfies this characteristic, one or more of the sequences of a cluster remain in the list of candidates. If a cluster does not satisfy this characteristic, then the sequences of the cluster are removed from the list of candidates at step 730. The total number of hits and queries may also be used, in addition to the number specifically in each genome.

In step 740, all the sequences in a given cluster are checked to determine if they are all flagged as 'non-coding'. If a cluster satisfies this characteristic, the cluster remains in the list of candidates, and if not, then it is removed in step 730. In step 750, sequences are checked if they have at least 60 nucleotides. In step 760, an assembly is checked to determine if the sequences of the assembly are at least 85% identical. In step 770, the remaining sequences are put into a working database of sequences.

This method helps to filter down the number of sequences to scan afterwards. The use of the cluster allows building a working database with sequences that have any of the characteristics of not coding for a gene, not over represented in the two compared genomes, sufficient length, or have at least 85% identity.

F. Analyzing Secondary Structure of Resulting Sequences

In one embodiment, the secondary structures of sequences in the list of candidates (working database) are analyzed. A pre-microRNA transcript is a precursor RNA having a stem-loop like structure. Using the working base (WB) described before, the inventors use folding algorithms to predict secondary structures of all the sequences in the WB in the forward and in the reverse strand. The algorithm which has been used comes from the Vienna package (Hofacker I L. Vienna RNA secondary structure Nucleic Acids Res., 2003, July 1; 31(13):3429-31).

Figure 8:
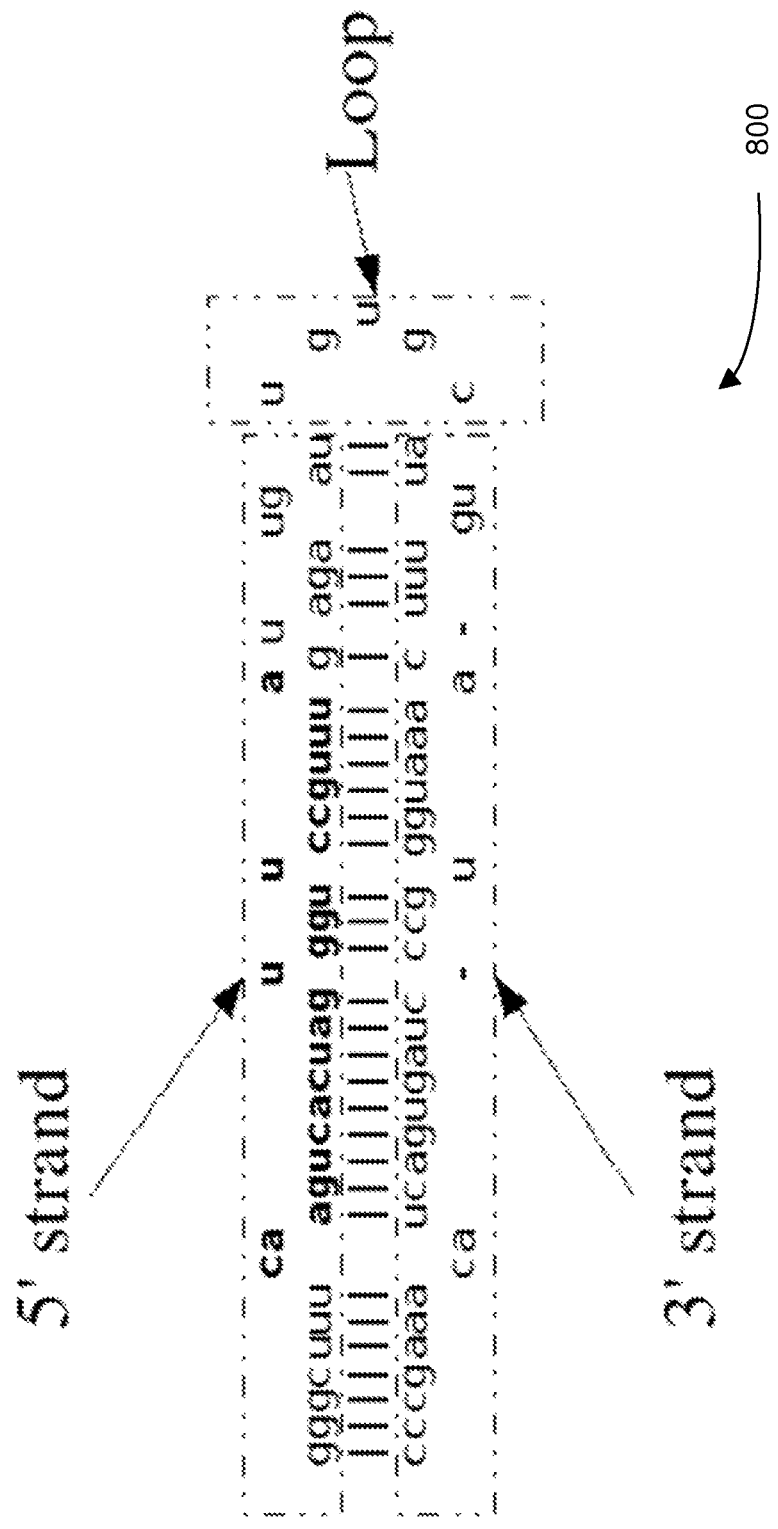
FIG. 8 illustrates a secondary structure of an exemplary sequence (SEQ ID NO: 7804) according to an embodiment of the present invention.

FIG. 8 illustrates a secondary structure 800 of an exemplary sequence. There is a 5' strand stem (arm), a 3' strand stem (arm), and a loop parts of secondary structure 800. In one aspect, the secondary structure is searched to locate a microRNA in the 5' strand stem or 3' strand end or both.

Knowing the secondary structure of a pre-microRNA, the results are parsed to find out if the sequences have a secondary structure which may correspond to the classical structure of pre-microRNA family members using an appropriate Perl script. Perl script evaluates a certain combination of criteria before accepting a sequence as a potential pre-microRNA candidate.

In one embodiment, sequences are identified that have a stem-loop secondary structure with a 5' strand (arm) stem having from 20 to 45 nucleotides and with a 3' strand stem having from 20 to 45 nucleotides. In one aspect, sequences are identified that also satisfy the following four criteria: (1) a number of nucleotides (nt) in the sequence, i.e. the pre-miRNA stem-loop; (2) a length of the loop; (3) a percent identity; and (4) a Zscore. The loop length is the length in nucleotides of the hairpin loop of the stem loop, i.e. not including arms. The percent identity is the percentage of conserved nucleotides between two sequences.

The Zscore is a statistical test. The principle of this method is to generate N random sequences having the same nucleotide composition of a given sequence. Each of these N random sequences are then folded and the Minimal Free Energy (MFE) is given. If R is the number of sequences with MFE<MFE of initial sequence, the Zscore equals R/(N+1). In one embodiment, the number of nucleotides (nt) required is 60-120 nt; the loop length is 4-15 nucleotides; and the percent identity is at least 85%.

In one embodiment, sequences with a Zscore (using N=1.000) less than 0.06 are kept. When a sequence and its reverse complement are less than 0.06, the one with the lower Zscore is kept. In one aspect, if the sequence comes from an orthologous region with less than 100% identity, the same statistical test is applied to the orthologous sequence. In another aspect, the sequence is kept, if the orthologous one is also under 0.06.

In one embodiment, four more criteria are analyzed to determine if a predetermined number (subset) of them are satisfied: (1) energy (MFE); (2) % GC; (3) % of base pairing; and (4) minimum conserved nucleotide of one arm. The "% GC" is the percentage of nucleotides G+C in a given sequence. The "% base pairing" is the number of bases which are paired between the two arms. The minimum number of conserved nucleotides of one arm (Arm conserved) is the minimum number of nucleotides, which are perfectly conserved between the two species compared in at least one arm of the stem loop. In one embodiment, the following values for the criteria are used: % GC from 30 to 51%; percentage base pairing between 30 and 40%; a Minimum Free Energy less than 25 kcal/mol; and a minimum 17 nucleotides are perfectly conserved between the two species compared in at least one arm of the stem loop. In one aspect, three of the four criteria are required to be satisfied.

Figure 9:
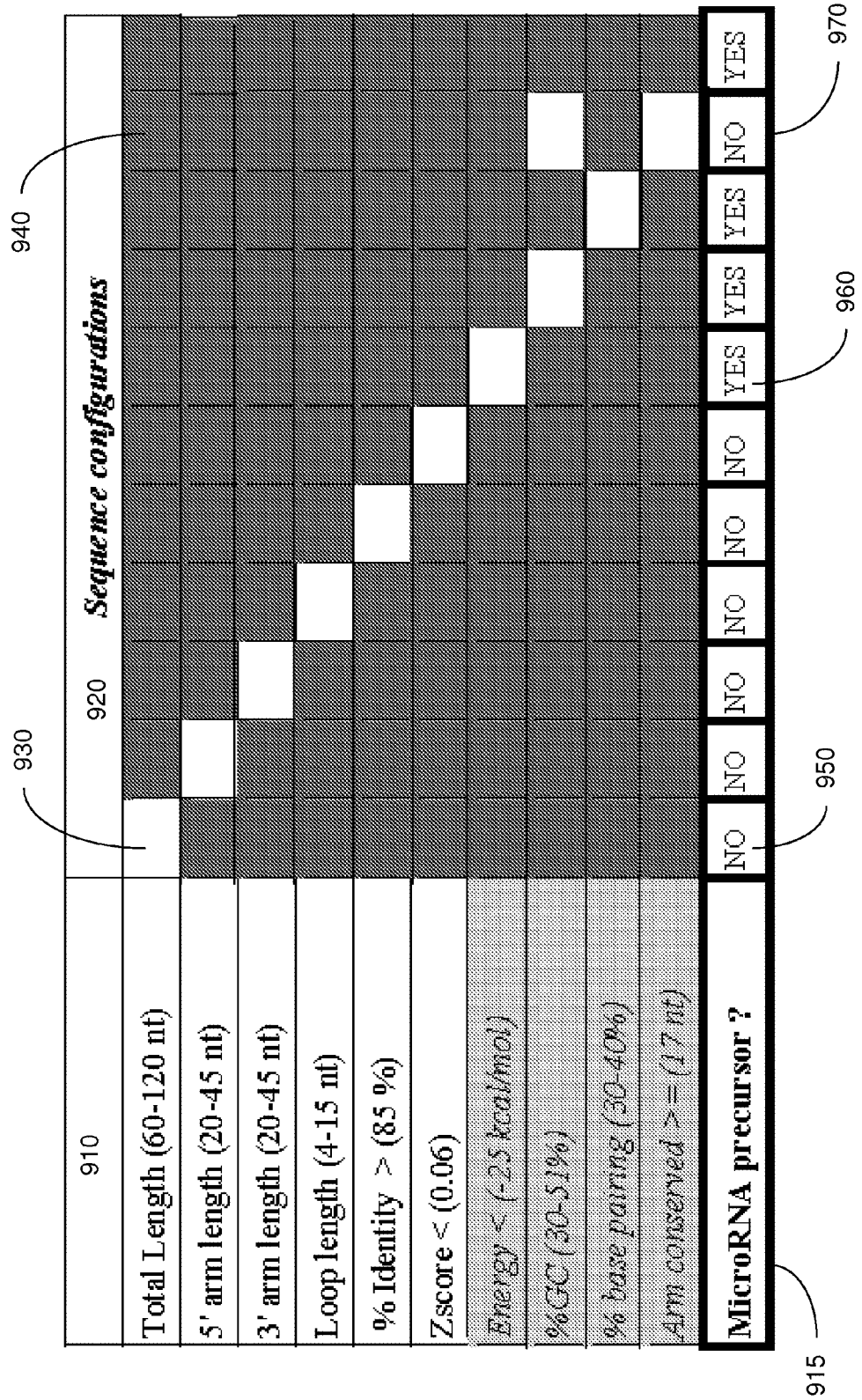
FIG. 9 illustrates a table showing the criteria and the decision of whether a sequence is a microRNA precursor candidates according to an embodiment of the present invention.

FIG. 9 illustrates a table 900 showing the criteria and the decision of whether a sequence is a microRNA precursor candidate. Column 910 lists ten different criteria. In one embodiment, each of the first six criteria (with the light background) is deemed required. The last four criteria (with a shaded background) are deemed optional, and only a subset of them are required. In one aspect, three out of the last four criteria are required. Each of columns 920 signify a sequence whose secondary structure is analyzed. Row 915 shows the decision as to whether a sequence is a candidate.

A white box 930 signifies that the criterion is not satisfied. A dark box 940 signifies that the criterion is satisfied. In one embodiment, sequence 950 is deemed to not be a candidate as the first required criteria of total length is not satisfied. In one embodiment, sequence 960 is deemed to be a candidate since only one optional criterion (energy) is not satisfied. In one embodiment, sequence 970 is deemed not to be a candidate since two optional criteria (% GC and ARM conserved) are not satisfied.

In one embodiment, when a stem-loop is found, the exact positions of the 5' strand start and the exact positions of the 3' strand end are extracted to make a new sequence. This new sequence is then folded again and the structure parsed again to see if it fits with a secondary structure corresponding to a pre-microRNA stem-loop. This is done because secondary structure may change according to the neighbouring nucleotide sequence. Genomic positions of sequences having a pre-microRNA secondary like structure are kept in the database. In one aspect, sequences are computed to find their tissue annotations by comparison with the dbEST database. FIG. 10 illustrates secondary structures of select sequences.

III. Sequences Identified by the Present Methods

A. Isolated Nucleic Acids

In one aspect, present invention provides isolated pre-microRNA nucleic acid molecules, identified by the method of the invention, selected from the group of pre-microRNA molecules consisting of the pre-microRNA molecules having the following nucleic acid sequences:

a) a nucleic RNA sequence having a DNA sequence selecting from the group consisting of the DNA sequences SEQ ID NOs. 1 to 1694 and 4035 to 5758, preferably of the DNA sequences SEQ ID NOs. 3, 5, 16, 22, 32, 34, 35, 36, 60, 70, 77, 81, 82, 90, 93, 139, 141, 151, 152, 158, 163, 170, 175, 176, 183, 184, 191, 192, 200, 205, 219, 223, 224, 248, 275, 276, 323, 328, 344, 357, 363, 366, 385, 400, 406, 407, 425, 472, 481, 489, 500, 501, 503, 512, 527, 530, 531, 563, 608, 633, 640, 651, 653, 664, 678, 728, 744, 753, 784, 785, 786, 826, 832, 858, 876, 903, 909, 911, 926, 927, 940, 942, 944, 946, 947, 951, 955, 963, 967, 975, 1055, 1060, 1083, 1118, 1129, 1137, 1145, 1160, 1161, 1166, 1173, 1174, 1175, 1198, 1205, 1207, 1217, 1233, 1238, 1251, 1267, 1299, 1321, 1323, 1343, 1352, 1396, 1403, 1429, 1485, 1531, 1545, 1547, 1559, 1586, 1592, 1601, 1610, 1611, 1617, 1634, 1645, 1649, 1653, 1656, 1661, 1667, 1681, 1686, 1688, 1693 and 4773;

b) a nucleic sequences having at least 80%, preferably at least, 85% or 90% and more preferably at least 95%, identity after optimum alignment with a sequence as defined in a);

c) a complementary sequence of a sequence as defined in a) or b);

d) a DNA molecule coding for a sequence as defined in a), b) or c); and e) a nucleic sequence having at least 12 nucleotides length, preferably 13, 14, 15, 16, 17, 18, 19, 20, 21, 22, 23, 24, 25 and 26 nucleotides length, and at most 30 nucleotides length, preferably 35, 40, 45, 50, 60, 75, 80, 90 and 100, which hybridizes under stringent conditions to a sequence as defined in a), b), c) or d).

In another aspect, present invention provides isolated microRNA nucleic acid molecules, identified by the method of the invention, selected from the group of microRNA molecules consisting of the microRNA molecules having the following nucleic acid sequences:

a) a nucleic RNA sequence having a DNA sequence selecting from the group consisting of the DNA sequences SEQ ID NOs. 1695-4004 and 5759-7803, preferably of the DNA sequences SEQ ID NOs. 1697, 1698, 1700, 1719, 1720, 1730, 1731, 1732, 1744-1750, 1784, 1785, 1805-1807, 1815-1818, 1824-1828, 1837-1839, 1842, 1843, 1896-1900, 1911-1917, 1925, 1926, 1933, 1934, 1944, 1945, 1949-1954, 1959-1964, 1975-1979, 1990-1993, 2000-2002, 2025-2027, 2068, 2108, 2111, 2112, 2173-2175, 2180, 2181, 2201-2203, 2219-2221, 2228, 2229, 2231-2237, 2260, 2278-2280, 2313, 2314, 2408-2410, 2427-2434, 2437, 2438, 2532, 2450, 2451, 2469-2471, 2476, 2477, 2613, 2620-2622, 2637, 2648, 2679, 2730, 2754-2756, 2771, 2809, 2810, 2814, 2815, 2862, 2863, 2870-2872, 2900, 2958-2961, 2966-2968, 2971-2974, 2999-3001, 3015, 3017-3019, 3021, 3023-3027, 3029, 3030, 3038, 3039, 3048-3050, 3052-3054, 3061, 3062, 3162, 3189, 3232, 3233, 3249, 3250, 3271-3274, 3300-3304, 3320-3329, 3363, 3372-3375, 3378, 3379, 3391, 3392, 3416, 3417, 3422-3424, 3440-3442, 3461, 3497-3499, 3528, 3555-3557, 3567, 3619-3621, 3627, 3628, 3663, 3786, 3804-3808, 3862, 3863, 3870, 3871, 3896-3898, 3912, 3931, 3943, 3950, 3951, 3956, 3957, 3959, 3960, 3966-3968, 3973-3976, 3986, 3987, 3991-3994, 4001-4004;

b) a nucleic sequences having at least 80%, preferably at least, 85% or 90% and more preferably at least 95%, identity after optimum alignment with a sequence as defined in a);

c) a complementary sequence of a sequence as defined in a) or b);

d) a DNA molecule coding for a sequence as defined in a), b) or c); and e) a nucleic sequence having at least 12 nucleotides length, preferably 13, 14, 15, 16, 17, 18, 19, 20, 21, 22, 23, 24, 25 and 26 nucleotides length, and at most 30 nucleotides length, preferably 35, 40, 45, 50, 60, 75, 80, 90 and 100, which hybridizes under stringent conditions to a sequence as defined in a), b), c) or d).

In a preferred embodiment, the invention pertains to an isolated pre-microRNA nucleic acid molecule, identified by the method of the invention, selected from the group of pre-microRNA molecules consisting of the pre-microRNA molecules having the following nucleic acid sequences:

a) a nucleic acid sequence of a fragment having at least 15 consecutive nucleotides, preferably 16, 17, 18, 19, and 20 nucleotides length, and at most 24, preferably 25, 26, 27, 28, 29 and 30 nucleotides length, more preferably at least 19 and at most 24 nucleotides length, of a pre-microRNA nucleic acid sequence having a DNA sequence selecting from the group consisting of the sequences SEQ ID NOs. 1 to 1694 and 4035 to 5758, preferably of a pre-microRNA nucleic acid sequence having a DNA sequence selected from the group SEQ ID NO. 3, 5, 16, 22, 32, 34, 35, 36, 60, 70, 77, 81, 82, 90, 93, 139, 141, 151, 152, 158, 163, 170, 175, 176, 183, 184, 191, 192, 200, 205, 219, 223, 224, 248, 275, 276, 323, 328, 344, 357, 363, 366, 385, 400, 406, 407, 425, 472, 481, 489, 500, 501, 503, 512, 527, 530, 531, 563, 608, 633, 640, 651, 653, 664, 678, 728, 744, 753, 784, 785, 786, 826, 832, 858, 876, 903, 909, 911, 926, 927, 940, 942, 944, 946, 947, 951, 955, 963, 967, 975, 1055, 1060, 1083, 1118, 1129, 1137, 1145, 1160, 1161, 1166, 1173, 1174, 1175, 1198, 1205, 1207, 1217, 1233, 1238, 1251, 1267, 1299, 1321, 1323, 1343, 1352, 1396, 1403, 1429, 1485, 1531, 1545, 1547, 1559, 1586, 1592, 1601, 1610, 1611, 1617, 1634, 1645, 1649, 1653, 1656, 1661, 1667, 1681, 1686, 1688, 1693 and 4773;

b) a nucleic acid sequence having at least 80%, preferably at least, 85% or 90% and more preferably at least 95%, identity after optimum alignment with a sequence as defined in a);

c) a complementary sequence of a sequence as defined in a) or b);

d) a DNA molecule coding for a sequence as defined in a), b) or c); and e) a nucleic acid sequence having at least 12 nucleotides length, preferably 13, 14, 15, 16, 17, 18, 19, 20, 21, 22, 23, 24, 25 and 26 nucleotides length, and at most 30 nucleotides length, preferably 35, 40, 45, 50, 75 and 100, which hybridizes under stringent conditions to a sequence as defined in a), b), c) or d).

In another embodiment, the isolated microRNA nucleic acid molecule according to the present invention is selected from the group of microRNA molecules consisting of the microRNA molecules having the following nucleic acid sequences:

a) a nucleic sequence of a fragment having at least 15 consecutive nucleotides, preferably 16, 17, 18, 19, and 20 nucleotides length, and at most 24, preferably, 25, 26, 27, 28, 29 and 30 nucleotides length, more preferably at least 19 and at most 24 nucleotides length, of a pre-microRNA nucleic acid sequence having a DNA sequence selected from the group of the sequences SEQ ID NOs. 1 to 1694 and 4035 to 5758, said fragment further having at least 10 consecutive nucleotides of a microRNA nucleic acid sequence having a DNA sequence selected from the group of the sequences SEQ ID NOs. 1695-4004 and 5759-7803, preferably of the microRNA nucleic acid sequences having a DNA sequence selected from the group consisting of SEQ ID NOs. 1697, 1698, 1700, 1719, 1720, 1730, 1731, 1732, 1744-1750, 1784, 1785, 1805-1807, 1815-1818, 1824-1828, 1837-1839, 1842, 1843, 1896-1900, 1911-1917, 1925, 1926, 1933, 1934, 1944, 1945, 1949-1954, 1959-1964, 1975-1979, 1990-1993, 2000-2002, 2025-2027, 2068, 2108, 2111, 2112, 2173-2175, 2180, 2181, 2201-2203, 2219-2221, 2228, 2229, 2231-2237, 2260, 2278-2280, 2313, 2314, 2408-2410, 2427-2434, 2437, 2438, 2532, 2450, 2451, 2469-2471, 2476, 2477, 2613, 2620-2622, 2637, 2648, 2679, 2730, 2754-2756, 2771, 2809, 2810, 2814, 2815, 2862, 2863, 2870-2872, 2900, 2958-2961, 2966-2968, 2971-2974, 2999-3001, 3015, 3017-3019, 3021, 3023-3027, 3029, 3030, 3038, 3039, 3048-3050, 3052-3054, 3061, 3062, 3162, 3189, 3232, 3233, 3249, 3250, 3271-3274, 3300-3304, 3320-3329, 3363, 3372-3375, 3378, 3379, 3391, 3392, 3416, 3417, 3422-3424, 3440-3442, 3461, 3497-3499, 3528, 3555-3557, 3567, 3619-3621, 3627, 3628, 3663, 3786, 3804-3808, 3862, 3863, 3870, 3871, 3896-3898, 3912, 3931, 3943, 3950, 3951, 3956, 3957, 3959, 3960, 3966-3968, 3973-3976, 3986, 3987, 3991-3994, 4001-4004;

b) an RNA sequence having a DNA sequence selected from the group of the sequences SEQ ID NOs. SEQ ID NOs. 1695-4004 and 5759-7803, preferably of the microRNA nucleic acid sequences having a DNA sequence selected from the group consisting of SEQ ID NOs. 1697, 1698, 1700, 1719, 1720, 1730, 1731, 1732, 1744-1750, 1784, 1785, 1805-1807, 1815-1818, 1824-1828, 1837-1839, 1842, 1843, 1896-1900, 1911-1917, 1925, 1926, 1933, 1934, 1944, 1945, 1949-1954, 1959-1964, 1975-1979, 1990-1993, 2000-2002, 2025-2027, 2068, 2108, 2111, 2112, 2173-2175, 2180, 2181, 2201-2203, 2219-2221, 2228, 2229, 2231-2237, 2260, 2278-2280, 2313, 2314, 2408-2410, 2427-2434, 2437, 2438, 2532, 2450, 2451, 2469-2471, 2476, 2477, 2613, 2620-2622, 2637, 2648, 2679, 2730, 2754-2756, 2771, 2809, 2810, 2814, 2815, 2862, 2863, 2870-2872, 2900, 2958-2961, 2966-2968, 2971-2974, 2999-3001, 3015, 3017-3019, 3021, 3023-3027, 3029, 3030, 3038, 3039, 3048-3050, 3052-3054, 3061, 3062, 3162, 3189, 3232, 3233, 3249, 3250, 3271-3274, 3300-3304, 3320-3329, 3363, 3372-3375, 3378, 3379, 3391, 3392, 3416, 3417, 3422-3424, 3440-3442, 3461, 3497-3499, 3528, 3555-3557, 3567, 3619-3621, 3627, 3628, 3663, 3786, 3804-3808, 3862, 3863, 3870, 3871, 3896-3898, 3912, 3931, 3943, 3950, 3951, 3956, 3957, 3959, 3960, 3966-3968, 3973-3976, 3986, 3987, 3991-3994, 4001-4004;

c) a nucleic sequence having at least 80%, preferably of at least 85% or 90% and more preferably of at least 95%, identity after optimum alignment with a sequence as defined in a) or b);

d) a complementary sequence of a sequence as defined in a), b) or c);

e) a DNA molecule coding for a sequence as defined in a), b), c) or d); and f) a nucleic sequence having at least 12 nucleotides length, preferably 13, 14, 15, 16, 17, 18, 19, 20, 21, 22, 23, 24, 25 and 26 nucleotides length, and at most 30 nucleotides length, preferably 35, 40, 45, 50, 75 and 100, which hybridizes under stringent conditions to a sequence as defined in a), b), c), d) or e).

By "a nucleic RNA, microRNA or pre-microRNA sequence having a DNA sequence selecting from the group", it is intended to designate the RNA nucleic acid having the referenced DNA sequence wherein each thymine base has been replaced by an uracile base.

By "a DNA molecule coding for a sequence as defined in a)", it is intended to designate the DNA nucleic acid sequence having the DNA sequence formulated in a), or having the referenced RNA sequence wherein each uracile base has been replaced by a thymine base.

It should be understood that the invention does not relate to nucleic sequences or in a natural form, that is to say that they are not taken in their natural environment but that they can be obtained by purification from natural sources, or alternatively obtained by genetic recombination, or alternatively by chemical synthesis.

Nucleic sequence or nucleic acid is understood to mean an isolated natural, or a synthetic, DNA and/or RNA fragment comprising, natural or non-natural nucleotides, designating a precise succession of nucleotides, non-modified or modified, allowing a fragment, a segment or a region of a nucleic acid to be defined.

The isolated nucleic acid molecules according to the present invention which can be in a single stranded, partially double stranded or double stranded form.

B. Solid Supports

In another aspect, the present invention provides solid supports, that can be used for the detection and/or the quantification of the expression of a pre-microRNA, microRNA, or derived nucleic acid thereof, of the present invention.

In one embodiment, the solid support is characterized in that it comprises binding to said support at least:

a)—a nucleic acid having at least 15 consecutive nucleotides, preferably 16, 17, 18, 19, and 20 nucleotides length, and at most 24, preferably, 25, 26, 27, 28, 29 and 30 nucleotides length, more preferably at least 19 and at most 24 nucleotides length, of a fragment of nucleic acid sequence selected from the group of the sequences SEQ ID NOs. 1 to 1694 and 4035 to 5758, preferably a nucleic sequence of a fragment having at least 15 consecutive nucleotides, preferably 16, 17, 18, 19, and 20 nucleotides length, and at most 24, preferably, 25, 26, 27, 28, 29 and 30 nucleotides length, more preferably at least 19 and at most 24 nucleotides length, of the nucleic sequences SEQ ID NO. 3, 5, 16, 22, 32, 34, 35, 36, 60, 70, 77, 81, 82, 90, 93, 139, 141, 151, 152, 158, 163, 170, 175, 176, 183, 184, 191, 192, 200, 205, 219, 223, 224, 248, 275, 276, 323, 328, 344, 357, 363, 366, 385, 400, 406, 407, 425, 472, 481, 489, 500, 501, 503, 512, 527, 530, 531, 563, 608, 633, 640, 651, 653, 664, 678, 728, 744, 753, 784, 785, 786, 826, 832, 858, 876, 903, 909, 911, 926, 927, 940, 942, 944, 946, 947, 951, 955, 963, 967, 975, 1055, 1060, 1083, 1118, 1129, 1137, 1145, 1160, 1161, 1166, 1173, 1174, 1175, 1198, 1205, 1207, 1217, 1233, 1238, 1251, 1267, 1299, 1321, 1323, 1343, 1352, 1396, 1403, 1429, 1485, 1531, 1545, 1547, 1559, 1586, 1592, 1601, 1610, 1611, 1617, 1634, 1645, 1649, 1653, 1656, 1661, 1667, 1681, 1686, 1688, 1693, 4773;

or a nucleic sequence of a fragment having at least 15 consecutive nucleotides, preferably 16, 17, 18, 19, and 20 nucleotides length, and at most 24, preferably, 25, 26, 27, 28, 29 and 30 nucleotides length, more preferably at least 19 and at most 24 nucleotides length, of the sequences SEQ ID NOs. 1695 to 4004 and 5759 to 7803, preferably a nucleic sequence of a fragment having at least 15 consecutive nucleotides, preferably 16, 17, 18, 19, and 20 nucleotides length, and at most 24, preferably, 25, 26, 27, 28, 29 and 30 nucleotides length, more preferably at least 19 and at most 24 nucleotides length, of the nucleic sequences SEQ ID NOs. 1697, 1698, 1700, 1719, 1720, 1730, 1731, 1732, 1744-1750, 1784, 1785, 1805-1807, 1815-1818, 1824-1828, 1837-1839, 1842, 1843, 1896-1900, 1911-1917, 1925, 1926, 1933, 1934, 1944, 1945, 1949-1954, 1959-1964, 1975-1979, 1990-1993, 2000-2002, 2025-2027, 2068, 2108, 2111, 2112, 2173-2175, 2180, 2181, 2201-2203, 2219-2221, 2228, 2229, 2231-2237, 2260, 2278-2280, 2313, 2314, 2408-2410, 2427-2434, 2437, 2438, 2532, 2450, 2451, 2469-2471, 2476, 2477, 2613, 2620-2622, 2637, 2648, 2679, 2730, 2754-2756, 2771, 2809, 2810, 2814, 2815, 2862, 2863, 2870-2872, 2900, 2958-2961, 2966-2968, 2971-2974, 2999-3001, 3015, 3017-3019, 3021, 3023-3027, 3029, 3030, 3038, 3039, 3048-3050, 3052-3054, 3061, 3062, 3162, 3189, 3232, 3233, 3249, 3250, 3271-3274, 3300-3304, 3320-3329, 3363, 3372-3375, 3378, 3379, 3391, 3392, 3416, 3417, 3422-3424, 3440-3442, 3461, 3497-3499, 3528, 3555-3557, 3567, 3619-3621, 3627, 3628, 3663, 3786, 3804-3808, 3862, 3863, 3870, 3871, 3896-3898, 3912, 3931, 3943, 3950, 3951, 3956, 3957, 3959, 3960, 3966-3968, 3973-3976, 3986, 3987, 3991-3994, 4001-4004;

b) one nucleic acid having at least 80%, preferably of at least 85% or 90% and more preferably of at least 95%, identity after optimum alignment with a nucleic acid as defined in a); or c) one nucleic acid having a complementary sequence of a nucleic acid as defined in a) or b); or d) a RNA nucleic acid having a DNA nucleic acid as defined in a), b) or c); or e) a nucleic acid having at least 15 nucleotides length which hybridizes under stringent conditions to a nucleic acid as defined in a), b), c) or d).

In another preferred embodiment, the solid supports of the present invention is characterized in that it comprises binding to said support at least one nucleic acid selected from the group consisting of the oligonucleotide probes depicted in Table 3, preferably at least one oligonucleotide probe corresponding to a positive control and at least one different oligonucleotide probe corresponding to a negative control for the type of tissue or cell which is desired to be tested for expression of certain pre-micro RNAs or microRNAs (see Example 3 below).

In a further preferred embodiment, the solid support is characterized in that it comprises binding to said support at least 3418 nucleic acids, wherein these 3418 nucleic acids are:

for each nucleic acid sequence SEQ ID NOs. 1 to 1694 and SEQ ID NOs. 4035 to 5758, a) a nucleic sequence of a fragment having at least 15 consecutive nucleotides, preferably 16, 17, 18, 19, and 20 nucleotides length, and at most 24, preferably, 25, 26, 27, 28, 29 and 30 nucleotides length, more preferably at least 19 and at most 24 nucleotides length, of said sequence SEQ ID NOs. 1 to 1694 and 4035 to 5758, preferably of the sequences SEQ ID NOs. 1695 to 4004 and 5759 to 7803; or b) a nucleic acid having at least 80%, preferably of at least 85% or 90% and more preferably of at least 95%, identity after optimum alignment with a nucleic acid as defined in a); or c) a nucleic acid having a complementary sequence of an acid nucleic as defined in a) or b); or d) a RNA nucleic acid having a DNA nucleic acid sequence as defined in a), b) or c); or e) a nucleic sequence which hybridizes under stringent conditions to a nucleic acid as defined in a), b), c) or d).

In another aspect, the present invention provides solid supports comprising at least 5 pre-microRNA and/or microRNA capture sequences, wherein the capture sequences are at least 15 nucleotides in length and have substantial sequence complementarity to a pre-microRNA or microRNA identified by the methods of the invention. In some embodiments, the capture sequences are at least about 13, 14, 15, 16, 17, 18, 19, 20, 21, 22, 23, 24, 25, 26, 28, 30, 35 or 40 nucleotides in length. The nucleotides can be DNA, RNA, peptide nucleic acids ("PNA"), or analogs thereof. The capture nucleic acids can comprise one or more non-naturally occurring nucleotide bases. In some embodiements, the capture sequences having substantial complementarity have at least 93% (i.e., 1 mismatch in 15 nucleotides), 94%, 95%, 96%, 97%, 98%, or 99% sequence complementarity to a pre-microRNA or microRNA identified by the methods of the invention.

In some embodiments, the solid support comprises 5 or more capture sequences having substantial complementarity or 100% sequence complementarity to a pre-microRNA selected from the group consisting of SEQ ID NOs. 1-1694, 4035-5758, and the complements thereof. In some embodiments, the solid support comprises 5 or more capture sequences have substantial complementarity or 100% sequence complementarity to a microRNA selected from the group consisting of SEQ ID NOs. 1695-4004, 5759-7803, and the complements thereof. In another embodiment, the solid support comprises 5 or more capture sequences have substantial complementarity or 100% sequence complementarity to a microRNA probe selected from the group consisting of SEQ ID NOs. 4005-4034, and the complements thereof.

In one embodiment, the solid support comprises 5 or more pre-microRNA capture sequences having 100% sequence complementarity to a pre-microRNA selected from the group consisting of SEQ ID NOs. 3, 5, 16, 22, 32, 34, 35, 36, 60, 70, 77, 81, 82, 90, 93, 139, 141, 151, 152, 158, 163, 170, 175, 176, 183, 184, 191, 192, 200, 205, 219, 223, 224, 248, 275, 276, 323, 328, 344, 357, 363, 366, 385, 400, 406, 407, 425, 472, 481, 489, 500, 501, 503, 512, 527, 530, 531, 563, 608, 633, 640, 651, 653, 664, 678, 728, 744, 753, 784, 785, 786, 826, 832, 858, 876, 903, 909, 911, 926, 927, 940, 942, 944, 946, 947, 951, 955, 963, 967, 975, 1055, 1060, 1083, 1118, 1129, 1137, 1145, 1160, 1161, 1166, 1173, 1174, 1175, 1198, 1205, 1207, 1217, 1233, 1238, 1251, 1267, 1299, 1321, 1323, 1343, 1352, 1396, 1403, 1429, 1485, 1531, 1545, 1547, 1559, 1586, 1592, 1601, 1610, 1611, 1617, 1634, 1645, 1649, 1653, 1656, 1661, 1667, 1681, 1686, 1688, 1693 and 4773, and the complements thereof.

In another embodiment, the solid support comprises 5 or more microRNA capture sequences having 100% sequence complementarity to a microRNA selected from the group consisting of SEQ ID NOs. 1697, 1698, 1700, 1719, 1720, 1730, 1731, 1732, 1744-1750, 1784, 1785, 1805-1807, 1815-1818, 1824-1828, 1837-1839, 1842, 1843, 1896-1900, 1911-1917, 1925, 1926, 1933, 1934, 1944, 1945, 1949-1954, 1959-1964, 1975-1979, 1990-1993, 2000-2002, 2025-2027, 2068, 2108, 2111, 2112, 2173-2175, 2180, 2181, 2201-2203, 2219-2221, 2228, 2229, 2231-2237, 2260, 2278-2280, 2313, 2314, 2408-2410, 2427-2434, 2437, 2438, 2532, 2450, 2451, 2469-2471, 2476, 2477, 2613, 2620-2622, 2637, 2648, 2679, 2730, 2754-2756, 2771, 2809, 2810, 2814, 2815, 2862, 2863, 2870-2872, 2900, 2958-2961, 2966-2968, 2971-2974, 2999-3001, 3015, 3017-3019, 3021, 3023-3027, 3029, 3030, 3038, 3039, 3048-3050, 3052-3054, 3061, 3062, 3162, 3189, 3232, 3233, 3249, 3250, 3271-3274, 3300-3304, 3320-3329, 3363, 3372-3375, 3378, 3379, 3391, 3392, 3416, 3417, 3422-3424, 3440-3442, 3461, 3497-3499, 3528, 3555-3557, 3567, 3619-3621, 3627, 3628, 3663, 3786, 3804-3808, 3862, 3863, 3870, 3871, 3896-3898, 3912, 3931, 3943, 3950, 3951, 3956, 3957, 3959, 3960, 3966-3968, 3973-3976, 3986, 3987, 3991-3994, 4001-4004, and the complements thereof.

In some embodiments, the solid support comprises at least 10, 25, 50, 96, 100, 192, 200, 384, 500, 768, 1000, 1536 or more capture nucleic acids based on the pre-microRNA and microRNA nucleic acid sequences identified by the present methods.

In some embodiments, the solid support is a nucleic acid (DNA, RNA, PNA, and analogs thereof) chip array, for example, for detection and/or the quantification of the expression of a pre-microRNA, microRNA, or derived nucleic acid thereof, of the present invention. DNA chip arrays are well known in the art and are commercially available, for example, from Affymetrix (GeneChip) or Hyseq (HyChip and HyGnostics). The chips can be made from silica, glass, metals, plastic polymers, ceramic, or any other appropriate material or materials.

C. Methods of Detection

In another aspect, the present invention is directed to methods of detecting pre-microRNA or microRNA in a cell, comprising conducting multiplex polymerase chain reaction (PCR) to amplify at least 5 target pre-microRNA or microRNA nucleic acid sequences using forward primers and reverse primers, wherein each forward and reverse primer pair member is complementary to at least 15 contiguous nucleotides of a nucleic acid sequence selected from the group consisting of SEQ ID NOs: 1-1694 and 4035-5758, and the complements thereof. In some embodiments, each forward and reverse primer pair member is complementary to at least 15 contiguous nucleotides of a nucleic acid sequence selected from the group consisting of SEQ ID NOs: 1695-4004 and 5759-7803. In some embodiments, at least 5, 6, 7, 8, 9, 10, 15, 20, 25, 30, 50, 100 or more pre-microRNA and/or microRNA nucleic acid sequences are amplified using multiplex PCR.

Multiplex PCR reaction is intended to designate a PCR reaction where more than one primer set is included in the reaction pool allowing 2 or more different DNA targets to be amplified by PCR in a single reaction tube. Multiplex PCR can be quantitative and can be evaluated "real-time." Multiplex PCR reactions are useful for validation, diagnostic and prognostic purposes.

Multiplex PCR reactions can be carried out using manual or automatic thermal cycling. Any commercially available thermal cycler may be used, such as, e.g., Perkin-Elmer 9600 cycler.

The reaction products obtained by multiplex PCR reaction can be analyzed using any of several methods that are well-known in the art, such as, e.g.:
  DNA chip comprising on the solid support the corresponding pre-microRNA or microRNA nucleic acid capture sequences;
  agarose gel electrophoresis. For this method, it is preferred that the different amplified sequences are of distinct sizes and thus can be resolved in a single gel;
  dot-blot hybridization with specific oligonucleotides; or
  SSCP method ("Single Stranded Conformational Polymorphism") which can distinguish similar sized DNA fragments according to the mobility of the single-stranded DNA under polyacrylamide gel electrophoresis.

For example, multiplex PCR reactions can be carried out, e.g., in a volume of 100 µl reaction mixtures containing e.g. 2 µg of DNA sample in 1×PCR buffer (10 mM Tris-HCl, pH 8.3, 50 mM KCl, 1.5 mM $MgCl_2$), 200 µM dNTPs, and 25-100 U/ml Taq polymerase (Perkin-Elmer, Norwalk, Conn.). Primer concentrations can be ranged from 0.25 to 1.0 µM. Amplifications were carried out using a Perkin-Elmer 9600 thermocycler (Perkin-Elmer, Norwalk, Conn.) for 28 cycles with ramping (melting at 94° C. for 10 s, annealing at 50° C., 55° C., 60° C. or 65° C. for 10 s, and extension at 72° C. for 10 s). The concentration of each primer in the reaction mixture can be ranged from about 0.05 to about 4 µM. The optimal concentration for primer can be evaluated by performing single PCR reactions using each primer pair individually. Similarly, each primer pair can be evaluated independently to confirm that all primer pairs to be included in a single multiplex PCR reaction require the same amplification conditions (i.e., temperature, duration of annealing and extension steps).

After completion of the reaction, e.g. 8 µl of the reaction products can be loaded directly onto a 2% ethidium bromide-stained agarose gel and subjected to electrophoresis at 250 volts for 90 minutes. The amplification products can be visualized with a UV transilluminator and photographed.

When multiplex PCR reaction is used for identifying the presence of specific DNA from a sample initially containing RNA, the multiplex PCR method comprises a prior step of incubating said RNA sample with a reverse transcriptase under conditions effective to produce a single-stranded DNA or cDNA from each RNA or mRNA the presence of which is desired to be tested.

In one embodiment of the method of detecting pre-microRNA or microRNA in a cell, comprising conducting multiplex PCR according to the present invention, said at least 5 target pre-microRNA or microRNA nucleic acid sequences which are amplified are pre-microRNA nucleic acid sequences selected from the group consisting of SEQ ID NOs: 1-1694 and 4035-5758.

In a further embodiment, the detection methods comprise the step of amplifying at least 5 pre-microRNA nucleic acid sequences selected from the group consisting of SEQ ID NOs. 3, 5, 16, 22, 32, 34, 35, 36, 60, 70, 77, 81, 82, 90, 93, 139, 141, 151, 152, 158, 163, 170, 175, 176, 183, 184, 191, 192, 200, 205, 219, 223, 224, 248, 275, 276, 323, 328, 344, 357, 363, 366, 385, 400, 406, 407, 425, 472, 481, 489, 500, 501, 503, 512, 527, 530, 531, 563, 608, 633, 640, 651, 653, 664, 678, 728, 744, 753, 784, 785, 786, 826, 832, 858, 876, 903, 909, 911, 926, 927, 940, 942, 944, 946, 947, 951, 955, 963, 967, 975, 1055, 1060, 1083, 1118, 1129, 1137, 1145, 1160, 1161, 1166, 1173, 1174, 1175, 1198, 1205, 1207, 1217, 1233, 1238, 1251, 1267, 1299, 1321, 1323, 1343, 1352, 1396, 1403, 1429, 1485, 1531, 1545, 1547, 1559, 1586, 1592, 1601, 1610, 1611, 1617, 1634, 1645, 1649, 1653, 1656, 1661, 1667, 1681, 1686, 1688, 1693 and 4773.

In another embodiment, the methods comprise the step of amplifying at least 5 microRNA nucleic acid sequences selected from the group consisting of SEQ ID NOs: 1695-4004 and 5759-7803.

In a further embodiment, the methods comprise the step of amplifying at least 5 microRNA nucleic acid sequences selected from the group consisting of SEQ ID NOs. 1697, 1698, 1700, 1719, 1720, 1730, 1731, 1732, 1744-1750, 1784, 1785, 1805-1807, 1815-1818, 1824-1828, 1837-1839, 1842, 1843, 1896-1900, 1911-1917, 1925, 1926, 1933, 1934, 1944, 1945, 1949-1954, 1959-1964, 1975-1979, 1990-1993, 2000-2002, 2025-2027, 2068, 2108, 2111, 2112, 2173-2175, 2180, 2181, 2201-2203, 2219-2221, 2228, 2229, 2231-2237, 2260, 2278-2280, 2389, 2390, 2399, 2313, 2314, 2408-2410, 2427-2434, 2437, 2438, 2450, 2451, 2469-2471, 2476, 2477, 2523, 2613, 2620-2622, 2637, 2648, 2679, 2730, 2754-2756, 2771, 2809, 2810, 2814, 2815, 2862, 2863, 2870-2872, 2900, 2958-2961, 2966-2968, 2971-2974, 2999-3001, 3015, 3017-3019, 3021, 3023-3027, 3029, 3030, 3038, 3039, 3048-3050, 3052-3054, 3061, 3062, 3162, 3189, 3249, 3250, 3261, 3271-3274, 3300-3304, 3320-3329, 3363, 3372-3375, 3378, 3379, 3391, 3392, 3416, 3417, 3422-3424, 3440-3442, 3461, 3497-3499, 3528, 3555-3560, 3567, 3619-3621, 3627, 3628, 3663, 3804-3808, 3862, 3863, 3870, 3871, 3896-3898, 3912, 3931, 3943, 3950, 3951, 3956, 3957, 3959, 3960, 3966-3968, 3973-3976, 3986, 3987, 3991-3994 and 4001-4004.

In a particular aspect, multiplex PCR is carried out for establishing pre-microRNA and/or microRNA expression profile in certain normal and pathologic tissue or cells:
  In prostate cells or tissue,
    the method comprises the step of amplifying at least 5 pre-microRNA nucleic acid sequences expressed by the prostate tissue, wherein said at least 5 pre-microRNA nucleic acid sequences are selected from the group consisting of SEQ ID NO. 3, 22, 32, 34, 90, 139, 163, 176, 248, 276, 328, 406, 472, 481, 407, 531, 608, 653, 678, 728, 785, 903, 926, 947, 963, 1055, 1118, 1137, 1173, 1174, 1196, 1198, 1485, 1531, 1159, 1592, 1601, 1656, 1667 and 1693; and/or
    the method comprises the step of amplifying at least 5 microRNA nucleic acid sequences expressed by the prostate tissue, wherein said at least 5 microRNA nucleic acid sequences are selected from the group consisting of SEQ ID NO. 1697, 1698, 1730-1732, 1744-1746, 1837-1839, 1896, 1897, 1933, 1934, 1952-1954, 2068, 2111, 2180, 2181, 2389, 2390, 2399, 2477, 2532, 2584-2587, 2730, 2811-2813, 2958-2961, 2999, 3025-

3027, 3048-3050, 3232, 3233, 3261, 3320-3325, 3363, 3558-3560, 3825, 3870, 3871, 3880-3882, 3959, 3960, 3973-3976 and 4001-4003.

In testes cells or tissue,
the method comprises the step of amplifying at least 5 pre-microRNA nucleic acid sequences expressed by the testes tissue, wherein said at least 5 pre-microRNA nucleic acid sequences are selected from the group consisting of SEQ ID NO. 36, 139, 205, 223, 328, 363, 406, 500, 563, 911, 946, 963, 1055, 1173, 1175, 1205, 1352, 1611 and 4773; and/or the method comprises the step of amplifying at least 5 microRNA nucleic acid sequences expressed by the testes tissue, wherein said at least 5 microRNA nucleic acid sequences are selected from the group consisting of SEQ ID NO.1749, 1750, 1896, 1897, 2000-2002, 2025, 2180, 2181, 2228, 2229, 2427-2430, 2523, 2971-2974, 3023, 3024, 3048-3050, 3320-3322, 3326-3329, 3372-3375, 3567 and 4004.

In muscle cells or tissue,
the method comprises the step of amplifying at least 5 pre-microRNA nucleic acid sequences expressed by the muscle tissue, wherein said at least 5 pre-microRNA nucleic acid sequences are selected from the group consisting of SEQ ID NO.3, 22, 32, 139, 163, 176, 328, 363, 472, 678, 728, 832, 947, 963, 1173, 1174, 1198, 1656 and 1693; and/or the method comprises the step of amplifying at least 5 microRNA nucleic acid sequences expressed by the muscle tissue, wherein said at least 5 microRNA nucleic acid sequences are selected from the group consisting of SEQ ID NO. 1697, 1698, 1730-1732, 1744, 1745, 1896, 1897, 1933, 1934, 1952-1954, 2180, 2181, 2228, 2229, 2389, 2390, 2730, 2872, 3048-3050, 3322-3325, 3363, 3959, 3960 and 4001-4003.

In liver cells or tissue,
the method comprises the step of amplifying at least 5 pre-microRNA nucleic acid sequences expressed by the liver tissue, wherein said at least 5 pre-microRNA nucleic acid sequences are selected from the group consisting of SEQ ID NO. 139, 328, 363, 728, 963, 1083 and 1173; and/or the method comprises the step of amplifying at least 5 microRNA nucleic acid sequences expressed by the liver tissue, wherein said at least 5 microRNA nucleic acid sequences are selected from the group consisting of SEQ ID NO. 1896, 2180, 2181, 2228, 2229, 2730, 2872, 3048-3050, 3189 and 3322.

In bone marrow cells or tissue,
the method comprises the step of amplifying at least 5 pre-microRNA nucleic acid sequences expressed by the bone marrow tissue, wherein said at least 5 pre-microRNA nucleic acid sequences are selected from the group consisting of SEQ ID NO.35, 328, 357, 363, 728, 963 and 1173; and/or the method comprises the step of amplifying at least 5 microRNA nucleic acid sequences expressed by bone marrow tissue, wherein said at least 5 microRNA nucleic acid sequences are selected from the group consisting of SEQ ID NO. 1747, 1748, 2180, 2181, 2219-2221, 2228, 2229, 2730, 3048-3050 and 3320-3322.

In kidney cells or tissue,
the method comprises the step of amplifying at least 5 pre-microRNA nucleic acid sequences expressed by the kidney tissue, wherein said at least 5 pre-microRNA nucleic acid sequences are selected from the group consisting of SEQ ID NO.139, 223, 328, 363, 728, 946, 963 and 1205; and/or the method comprises the step of amplifying at least 5 microRNA nucleic acid sequences expressed by kidney tissue, wherein said at least 5 microRNA nucleic acid sequences are selected from the group consisting of SEQ ID NO. 1896, 1897, 2025, 2026, 2180, 2181, 2228, 2229, 2730, 3023, 3024, 3048-3050 and 3372-3375.

In heart or brain cells or tissue,
the method comprises the step of amplifying at least 5 pre-microRNA nucleic acid sequences expressed by the heart or brain tissue, wherein said at least 5 pre-microRNA nucleic acid sequences are selected from the group consisting of SEQ ID NO. 139, 328, 728, 832, 858, 963 and 1173; and/or the method comprises the step of amplifying at least 5 microRNA nucleic acid sequences expressed by kidney tissue, wherein said at least 5 microRNA nucleic acid sequences are selected from the group consisting of SEQ ID NO. 1896, 1897, 2180, 2181, 2730, 2872, 2900, 3048-3050 and 3322.

In sperm cells or tissue,
the method comprises the step of amplifying at least 5 pre-microRNA nucleic acid sequences expressed by the sperm tissue, wherein said at least 5 pre-microRNA nucleic acid sequences are selected from the group consisting of SEQ ID NO.328, 363, 728, 926, 963 and 1173; and/or the method comprises the step of amplifying at least 5 microRNA nucleic acid sequences expressed by sperm tissue, wherein said at least 5 microRNA nucleic acid sequences are selected from the group consisting of SEQ ID NO. 2180, 2181, 2228, 2229, 2730, 2999, 3048-3050 and 3320-3322.

In spleen cells or tissue,
the method comprises the step of amplifying at least 5 pre-microRNA nucleic acid sequences expressed by the spleen tissue, wherein said at least 5 pre-microRNA nucleic acid sequences are selected from the group consisting of SEQ ID NO.139, 328, 363, 728 and 963; and/or the method comprises the step of amplifying at least 5 microRNA nucleic acid sequences expressed by spleen tissue, wherein said at least 5 microRNA nucleic acid sequences are selected from the group consisting of SEQ ID NO. 1896, 1897, 2180, 2181, 2228, 2229, 2730 and 3048-3050.

In thymus cells or tissue,
the method comprises the step of amplifying at least 5 pre-microRNA nucleic acid sequences expressed by the thymus tissue, wherein said at least 5 pre-microRNA nucleic acid sequences are selected from the group consisting of SEQ ID NO.139, 328, 363, 728, 963 and 1173; and/or the method comprises the step of amplifying at least 5 microRNA nucleic acid sequences expressed by thymus tissue, wherein said at least 5 microRNA nucleic acid sequences are selected from the group consisting of SEQ ID NO. 1896, 1897, 2180, 2181, 2228, 2229, 2730, 3048-3050 and 3320-3322.

In lung cells or tissue,
the method comprises the step of amplifying at least 5 microRNA nucleic acid sequences expressed by lung tissue, wherein said at least 5 microRNA nucleic acid sequences are selected from the group consisting of SEQ ID NO. 2870-2872 and 3048-3050.

In thymocytes cells,
the method comprises the step of amplifying at least 5 microRNA nucleic acid sequences expressed by thymocytes, wherein said at least 5 microRNA nucleic acid sequences are selected from the group consisting of SEQ ID NO. 1896, 1897, 2180, 2181, 2730 and 3048-3050.

In colon cells or tissue,
the method comprises the step of amplifying at least 5 microRNA nucleic acid sequences expressed by colon tissue, wherein said at least 5 microRNA nucleic acid sequences are selected from the group consisting of SEQ ID NO. 2180, 2181, 2228, 2229 and 3048-3050.

In blood cells or tissue,
the method comprises the step of amplifying at least 5 pre-microRNA nucleic acid sequences expressed by the blood tissue, preferably by the T cells, wherein said at least 5 pre-microRNA nucleic acid sequences are selected from the group consisting of SEQ ID NO. 3, 5, 16, 22, 32, 34, 35, 36, 60, 70, 77, 81, 82, 90, 93, 139, 141, 151, 152, 158, 163, 170, 175, 176, 183, 184, 191, 192, 200, 219, 223, 224, 248, 275, 276, 323, 328, 344, 363, 366, 385, 400, 425, 489, 500, 501, 503, 512, 527, 530, 531, 633, 640, 651, 653, 664, 678, 728, 744, 753, 784, 786, 826, 876, 903, 909, 911, 926, 927, 940, 942, 944, 947, 951, 955, 963, 967, 975, 1055, 1060, 1129, 1145, 1160, 1161, 1166, 1173, 1174, 1198, 1205, 1207, 1217, 1233, 1238, 1251, 1267, 1299, 1321, 1323, 1343, 1396, 1403, 1485, 1545, 1547, 1586, 1592, 1610, 1617, 1634, 1645, 1649, 1653, 1656, 1661, 1667, 1681, 1686, 1688, 1693, 4773; and/or
the method comprises the step of amplifying at least 5 microRNA nucleic acid sequences expressed by the blood tissue, preferably by the T cells, wherein said at least 5 microRNA nucleic acid sequences are selected from the group consisting of SEQ ID NO. 1697, 1698, 1700, 1719, 1720, 1730, 1731, 1732, 1744-1750, 1784, 1785, 1805-1807, 1815-1818, 1824-1828, 1837-1839, 1842, 1843, 1896-1900, 1911-1917, 1925, 1926, 1933, 1934, 1944, 1945, 1949-1954, 1959-1964, 1975-1979, 1990-1993, 2000-2002, 2025-2027, 2068, 2108, 2111, 2112, 2173-2175, 2180, 2181, 2201-2203, 2219-2221, 2228, 2229, 2231-2237, 2260, 2278-2280, 2313, 2314, 2408-2410, 2427-2434, 2437, 2438, 2532, 2450, 2451, 2469-2471, 2476, 2477, 2613, 2620-2622, 2637, 2648, 2679, 2730, 2754-2756, 2771, 2809, 2810, 2814, 2815, 2862, 2863, 2870-2872, 2900, 2958-2961, 2966-2968, 2971-2974, 2999-3001, 3015, 3017-3019, 3021, 3023-3027, 3029, 3030, 3038, 3039, 3048-3050, 3052-3054, 3061, 3062, 3162, 3189, 3232, 3233, 3249, 3250, 3271-3274, 3300-3304, 3320-3329, 3363, 3372-3375, 3378, 3379, 3391, 3392, 3416, 3417, 3422-3424, 3440-3442, 3461, 3497-3499, 3528, 3555-3557, 3567, 3619-3621, 3627, 3628, 3663, 3786, 3804-3808, 3862, 3863, 3870, 3871, 3896-3898, 3912, 3931, 3943, 3950, 3951, 3956, 3957, 3959, 3960, 3966-3968, 3973-3976, 3986, 3987, 3991-3994, 4001-4004.

Efficient access to the presence of microRNA in a biological sample can be obtained through for example a basic structure comprising high-density arrays of probes attached to a solid support (the chip) at selected positions. Each DNA chip can contain thousands to millions of individual synthetic DNA probes arranged in a grid-like pattern and miniaturized to the size of a dime.

In addition, the present invention provides the nucleic acids of the present invention as markers specific to human disease.

According to another embodiment, the present invention provides the use of a nucleic acid of the present invention as a marker for determining the onset/development of a human disease.

In a preferred embodiment, present invention to provide a method for the identification and characterization of an association between the presence or the quantity of a microRNA of the present invention and a trait.

The method of detecting an association between the presence or the quantity of a microRNA, or derived acid nucleic thereof or derived pre-microRNA thereof, of the present invention and a trait (or a phenotype), comprising the steps of:
a) determining the presence or the quantity of a microRNA of the present invention in trait positive population according to a method of the invention;
b) determining the presence or the quantitty of a microRNA of the present invention in a control population; and
c) determining whether a statistically significant association exists between said presence, or said quantity, and said trait.

For example, a trait+ population suffering from a disease involving the modulation of the expression of the protein encoded by the microRNA of the present invention.

The terms "trait" or "phenotype" are used interchangeably herein and refer to any visible, detectable or otherwise measurable property of an organism such as symptoms of, or susceptibility to a disease for example. Typically the terms "trait" or "phenotype" are used herein to refer to symptoms of, or susceptibility to a disease involving the gene whose mRNA is one of the target mRNA of the microRNA of the present invention.

The general strategy to perform association studies is to scan two group of individuals (trait+ and trait- control individuals which are characterized by a well defined phenotype as described below) in order to measure and statistically compare the presence or said quantity of such microRNA in both groups.

The invention also encompasses methods of determining whether a subject is at risk of developing a disease, comprising the steps of:
a) determining the presence or the quantity of a microRNA, or derived acid nucleic thereof or derived pre-microRNA thereof, of the present invention in the subject to be tested;
b) compare the results obtained in step a) to the presence or the quantity of said microRNA obtained to a control population; and
c) determining whether the presence or the quantity of a microRNA between said subject and the control is significant of a risk of developing said.

In another aspect, the present invention is directed to the use of a nucleic acid of the invention as a marker for the identification and/or the quantification of the presence of microRNA nucleic acid molecule, or derived pre-microRNA thereof, according to the present invention in a biological sample from an eukaryotic organism, preferably a mammal subject.

By derived pre-microRNA of microRNA nucleic acid molecule, it is intended to designate the pre-microRNA nucleic acid from which said microRNA is originated, as indicated in the numeric identifier <223> for each microRNA sequence of the invention (see the sequence listing). Are also intended to included in the wording "derived pre-microRNA thereof", the complementary and the sequences having at least 80% identity with said pre-RNA sequence identified under the identifier <223> in the sequence listing for each identified microRNA sequence of the present invention.

The term "mammals subject" includes particularly humans, dogs, cows, horses, kangaroos, pigs, sheep, goats, cats, mice, rabbits, rats, and transgenic non-human animals, preferably human.

It also provides an improved method and system for detection of the expression of novel oligonucleotides of the present invention, which modulate these target genes. In many cases the target genes may be known and fully characterized, however in alternative embodiments of the present invention, unknown or less well characterized genes may be targeted.

Preferably by microRNA nucleic acid molecule, or derivated pre-microRNA thereof, as marker according to the present invention, it is intended to designate the microRNA nucleic acid molecule of the invention or its pre-microRNA, also including their derived sequences such as fragment having at least 15 consecutive nucleotides thereof, nucleic acid having at least 80% identity, nucleic acid having a complementary sequence thereof, DNA nucleic acid coding therefore or nucleic sequence which hybridizes with these sequences as defined above for the microRNA and pre-microRNA nucleic acid molecule according to the present invention.

Samples for use in the assays of the invention when originating from mammal can be obtained by standard methods including venous puncture and surgical biopsy.

So, the present invention pertains to a method in vitro for the identification and/or the quantification of the presence microRNA nucleic acid molecule, or derived pre-microRNA thereof, in a biological sample from an eukaryotic organism, preferably from mammal, human being the most preferred, wherein said method comprises the use of a microRNA or a derived sequence thereof according to the present invention.

All the standard methods well known from a skilled person for the detection and/or the quantification of a target RNA nucleic acid in a biological sample can be used for the method of the present invention.

As described in more detail below, RT-PCR, quantitative RT-PCR, multiplex PCR methods can be used to detect or quantify the target microRNA, or derived pre-microRNA thereof.

For example, in vitro techniques for detection of target microRNA include Northern hybridizations and in situ hybridizations.

In a preferred embodiment, the invention relates to the methods according to the present invention, wherein the target microRNA, or derived pre-microRNA thereof, has a microRNA sequence as identified above for the microRNA molecule of the present invention.

When the methods according to the present invention are based to the detection or the quantification of target microRNA, or derived pre-microRNA thereof, it is also preferred that the determination of the presence, or the level, or the absence of target microRNA comprises a step of amplifying target microRNA or the cDNA coding therefore.

As used herein, the term "cDNA" shall refer to the DNA copy of the microRNA or from the pre-microRNA.

It is also preferred that the step of amplifying target microRNA or cDNA is performed by PCR (or PCR-like) or RT-PCR reaction.

"PCR" describes a method of gene amplification which involves sequenced-based hybridization of primers to specific genes within a DNA sample and subsequent amplification involving multiple rounds of annealing, elongation and denaturation using a heat-stable DNA polymerase.

"RT-PCR" is an abbreviation for reverse transcriptase-polymerase chain reaction. Subjecting mRNA to the reverse transcriptase enzyme results in the production of cDNA which is complementary to the base sequences of the mRNA. Large amounts of selected cDNA can then be produced by means of the polymerase chain reaction which relies on the action of heat-stable DNA polymerase.

"PCR-like" will be understood to mean all methods using direct or indirect reproductions of nucleic acid sequences, or alternatively in which the labeling systems have been amplified, these techniques are of course known, in general they involve the amplification of DNA by a polymerase; when the original sample is an RNA, it is advisable to carry out a reverse transcription beforehand. There are currently a great number of methods allowing this amplification, for example the so-called NASBA "Nucleic Acid Sequence Based Amplification", TAS "Transcription based Amplification System", LCR "Ligase Chain Reaction", "Endo Run Amplification" (ERA), "Cycling Probe Reaction" (CPR), and SDA "Strand Displacement Amplification", methods well known to persons skilled in the art.

In a more preferred embodiment, the invention pertains to the methods according to the present invention, wherein the primer or pair of primers used for the PCR or RT-PCR amplification is capable of amplifying a sequence of a microRNA, or derivated sequences thereof, of the present invention.

The term "primer", as used herein, refers to an oligonucleotide, whether occurring naturally (as in a purified restriction digest) or produced synthetically, and which is capable of initiating synthesis of a strand complementary to a nucleic acid when placed under appropriate conditions, i.e., in the presence of nucleotides and an inducing agent, such as a DNA polymerase, and at a suitable temperature and pH. A primer serves as an initiation point for nucleotide polymerization catalyzed by DNA polymerase, RNA polymerase or reverse transcriptase.

The primer may be either single-stranded or double-stranded and must be sufficiently long to prime the synthesis of the target microRNA in the presence of the inducing agent. The exact length of the primer will depend upon many factors, including temperature, sequence and/or homology of primer and the method used. For example, in diagnostic applications, the oligonucleotide primer typically contains at least 12 or more nucleotides, depending upon the complexity of the target sequence, although it may contain fewer nucleotides.

The primers herein are selected to be "substantially" complementary to the target microRNA, or derivated pre-microRNA thereof, or its cDNA sequence. This means that the primers must be sufficiently complementary to hybridize with their respective strands. Therefore, the primer sequence need not reflect the exact sequence of the template. For example, a non-complementary nucleotide fragment (i.e., containing a restriction site) may be attached to the 5' end of the primer, with the remainder of the primer sequence being complementary to the strand. Alternatively, non-complementary bases or longer sequences can be interspersed into the primer, provided that the primer sequence has sufficient complementary with the sequence to hybridize therewith and form the template for synthesis of the extension product.

This detection may be accomplished by isolating RNA from a sample. the method may be carried out by converting the isolated RNA to cDNA according to standard methods using reverse transcriptase (RT-PCR).

Following amplification, the presence or absence of the amplification product may be detected. The amplified product may be sequenced by any method known in the art. The sequenced amplified product is then compared to the reference. Alternatively, the nucleic acids may be fragmented into varying sizes of discrete fragments. For example, DNA fragments may be separated according to molecular weight by methods such as and not limited to electrophoresis through an agarose gel matrix. The gels are then analyzed by Southern hybridization.

In another embodiment, the invention relates to the methods according to the present invention, wherein the determining of the presence or the absence of the target microRNA is carried out by a probe capable of specifically hybridizing with the target microRNA.

The term "probe" denotes a defined nucleic acid segment (or nucleotide analog segment, e.g., polynucleotide as defined herein) which can be used to identify a specific polynucleotide sequence present in samples, said nucleic acid segment comprising a nucleotide sequence complementary of the specific polynucleotide sequence to be identified.

One preferred method for the detection or quantification of the target microRNA, or derived pre-microRNA thereof, involves contacting the isolated target microRNA, or derivated pre-microRNA thereof, with a nucleic acid probe that can hybridize to the target microRNA. Hybridization of the target microRNA with the probe indicates that the target microRNA is being expressed. In an embodiment, the probe includes a label group attached thereto, e.g., a radioisotope, a fluorescent compound, an enzyme, or an enzyme co-factor, or another molecule, such as a spacer molecule, in order to ameliorate the binding of this probe to a solid support.

In one format, the target microRNA, or derived pre-microRNA thereof, is immobilized on a solid surface and contacted with a probe, for example by running the isolated the target microRNA on an agarose gel and transferring the target microRNA from the gel to a membrane, such as nitrocellulose. In an alternative format, the probe(s) are immobilized on a solid surface and the target microRNA is contacted with the probe (s), for example, in an Affymetrix gene chip array, an SPR (Surface Plasmon Resonance) transparent solid support. A skilled artisan can readily adapt known RNA detection methods for use in detecting or quantifying the target microRNA in the method of the present invention.

In a particular embodiment, in the method according to the present invention, the step of the detection or of the quantitative measurement of the target microRNA, or derived pre-microRNA thereof, is carried out by quantitative PCR, preferably by real time RT-PCR.

Using a combination of appropriate oligonucleotide primers, the skilled artisan may determine the level of expression of a target gene in vitro by standard polymerase chain reaction (PCR) procedures, for example, by quantitative PCR. Conventional PCR based assays are discussed, for example, in Innes et al. (1995) "PCR Protocols; A guide to methods and Applications", Academic Press and Innes et al. (1995) "PCR Strategies" Academic Press, San Diego, Calif.

Real-time RT-PCR is a method that utilizes specifically engineered DNA sequences (two primers and a fluorescently labeled probe) to detect and quantify target sequences of DNA. The probe contains a fluorescent reporter dye on one end and a quencher dye on the other. During each amplification cycle, the probe first attaches to the target sequence of DNA, followed by attachment of the primers. As the DNA strand is copied, the reporter dye is released from the probe and emits a fluorescent signal. The amount of fluorescence increases with each cycle of PCR in proportion to the amount of target DNA. This results in direct detection and quantification of the target DNA sequence with a high degree of specificity, accuracy, and sensitivity.

In another embodiment, the present invention comprises the use of the solid support of the present invention for the detection or the quantification of target microRNA.

In another aspect, the present invention comprises a composition or a kit containing as at least one nucleic acid molecule of the present invention, for diagnostic applications.

These markers will be able to be used as molecules for diagnostic or prognostic application, they can also be used as therapeutic targets for new drugs or to lead to the design of new therapeutic tools based on the functional characteristics of synthetic microRNA.

D. Therapeutic Applications

So, in another aspect, the present invention comprises nucleic acid of the present invention as RNA drug, such as microRNA of the present invention or their antisense molecules.

RNA drugs have several advantages including less immunogenicity and toxicity. Their mechanism of action based on complementarities of bases, highly specific, and allow for the reduction of undesirable side effects. The strategies of development are considerably simpler. It is indeed much easier to conceive an antisens RNA than to find a molecule active in a very selective way on a protein, which lets hope for an acceleration of the marketing of new drugs.

We already know that the profiles of expression of the microRNA vary according to tissues. But recently, a team carried out a fine and precise classification of various human cancers, of which some very little differentiated, and of their stages of evolution by studying the profile of expression of the microRNA in these tissues (Lu J and al., 2005).

The antisense molecule of the present invention may comprise any nucleotide sequence portion complementary to the microRNA molecule of the invention, or nucleic acid derived thereof. The antisense molecule will naturally be a single stranded RNA- or DNA molecule of a certain nucleotide length, comprising particularly 15 to 50 nucleotides, preferably 18 to 40 nucleotides, more preferably 18 to 30 nucleotides, still more preferred 18 to 25 nucleotides.

In another aspect, the present invention a pharmaceutical composition containing as an active agent at least one nucleic acid molecule of the present invention, and optionally a pharmaceutically acceptable carrier, preferably for therapeutic applications.

In a preferred embodiment, the pharmaceutical composition of the present invention contains an antisense molecule of the present invention for specific modulating, preferably the enhancing, the expression of the target gene, preferably involved in human diseases.

"Enhancing the expression of target gene" is defined as the ability to prevent the inhibition by the microRNA of the synthesis of the protein encoded by the target gene by blocking the binding site of said microRNA to the untranslated region (UTR) of its target mRN, this binding of said microRNA inhibiting the translation of the target protein.

In this case modulation of translation of the protein encoded by the target may be achieved by inhibiting the complex formation between the target microRNA and its target mRNA, and thus the inhibition of the controlling cellular translation of the target gene by this microRNA.

In an also preferred embodiment, the pharmaceutical composition of the present invention contains a microRNA molecule of the present invention, or a derived pre-microRNA thereof, for specific modulation, preferably the inhibition, of the expression of a specific target gene, preferably involved in human diseases.

"Inhibition of the expression of a target gene" is defined as the ability to increase the inhibition by the microRNA of the synthesis of a specific protein encoded by the target gene by increasing the presence of microRNA and thus binding sites capable of binding the UTR of a target mRNA, increasing consequently the inhibition of the translation of the target protein.

In this case modulation of translation of the protein encoded by the target gene may be achieved by increasing the level of complex formation between the microRNA and its target mRNA, and thus increasing the controlling cellular translation of the target gene by this microRNA.

So, the present invention comprises a method for the treatment of disease in a subject due to an abnormal modulation of the expression of a target gene by a microRNA of the present invention, said method comprising administering said microRNA, or a derived pre-microRNA thereof or an antisense molecule of the present invention whose sequence is complementary to said microRNA.

To improve the stability against endogenous degradation antisense molecules may be protected by pharmaceutically acceptable protection groups commonly known by the person in the art.

The nucleic acid of the invention used for modulating the expression a target gene involved in human disease may be formulated for administration by various different routes, such as topical and systemic, e.g. oral, parenteral, inhalable, and the like, by slow release, by sustained release and by a pump, and the like, and are administered in amounts which prevent or reduce the biological effects brought about by the presence of microRNA into a cell.

The nucleic acids of the invention may be administered by themselves or in conjunction with other drugs and therapies, and in a preventative/prophylactive as well as a therapeutic course and may optionally co-formulated with carriers and other formulation ingredients as known in the art.

In general, the administration of the present nucleic acids may be conducted with formulations suitable for such kind of agents. Examples are injection solutions, wherein the active agents may be protected by e.g. including them in micelles. Aqueous and alcoholic solutions and suspensions, oily solutions and suspensions and oil in-water and water-in-oil emulsions, be a hydrophobic carrier, such as lipid vesicles or particles, such as liposomes.

In a further embodiment, the present invention also concerns a method for the screening of new agents acting on the activity of the microRNA, or derived nucleic acid thereof, of the present invention, new agents which may be suitable for the treatment of a patient whose disease is associated with a gene expression modulation provoked by the presence of said microRNA.

In a preferred embodiment, the invention relates to a method for the screening of an agent for their ability to alter the activity of the microRNA, or derived nucleic acid thereof, of the present invention.

The method comprises the following steps of:
a) providing a cell line, or an organ cell, expressing the microRNA of the present invention and the gene which is modulated by said microRNA, and wherein the gene modulation is associated with a disease;
b) obtaining a candidate agent; and
c) testing the ability of the candidate agent to modify the protein expression of the gene.

Such agents can find use for patients who are not responsive to existing drugs. Screening may be effected using preferably in vitro.

In vitro methods can be carried out in numerous ways such as on transformed cells which express the considered gene and or associated microRNA of the present invention.

Screening assays of the present invention generally involve determining the ability of a candidate agent to affect the activity of microRNA of the present invention on its target mRNA, such as the screening of agents to identify those that inhibit or otherwise modify the function of microRNA of the present invention on the protein expression encoded by the target mRNA.

One method of drug screening utilizes eukaryotic host cells which are stably transformed with recombinant polynucleotides. Such cells, either in viable or fixed form, can be used for standard binding assays. One can measure, for example, the formation of protein expression products or examine the degree to which the formation of such microRNA/target mRNA complexes is interfered by the tested agent.

E. Expression Systems

In another embodiment, the present invention pertains to a cloning or expression vector comprising a nucleic acid molecule of the invention.

The vectors according to the invention preferably contain elements which allow the expression of the nucleotide sequences in a determined host cell. The vector must therefore contain a promoter, signals of initiation and termination of translation, as well as appropriate regions of regulation of transcription. It must be able to be maintained in a stable manner in the host cell. These different elements are chosen and optimized by the person skilled in the art as a function of the host cell used. To this effect, the nucleotide sequences according to the invention can be inserted into autonomous replication vectors in the chosen host, or be integrative vectors of the chosen host.

Such vectors are prepared by methods currently used by the person skilled in the art, and the resulting clones can be introduced into an appropriate host by standard methods, such as lipofection, electroporation, thermal shock, or chemical methods.

The vectors according to the invention are, for example, vectors of plasmidic or viral origin. They are useful for transforming host cells in order to clone or to express the nucleotide sequences according to the invention.

As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. However, the invention is intended to include such other forms of vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence. The term "regulatory sequence" is intended to include promoters, enhancers and other expression control elements (e.g., polyadenylation signals). Such regulatory sequences are described, for example, in Goeddel; Gene Expression Technology Methods in Enzymology 185, Academic Press, San Diego, Calif. (1990), the disclosure of which is incorporated herein by reference in its entirety. Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the host cell to be transformed.

In yet another embodiment, a nucleic acid of the invention is expressed in mammalian cells using a mammalian expression vector. When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see Sambrook and Russell, 2001, supra, the disclosure of which is incorporated herein by reference in its entirety.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art.

The invention further provides a recombinant expression vector comprising a DNA molecule of the invention cloned into the expression vector in an antisense orientation compared to a the target microRNA. That is, the DNA molecule is operatively linked to a regulatory sequence in a manner which allows for expression (by transcription of the DNA molecule) of an RNA molecule which is antisense to a target microRNA. Regulatory sequences operatively linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced.

Another aspect of the invention pertains to host cells into which a recombinant cloning or expression vector of the invention has been introduced. The terms "host cell" and "recombinant host cell" are used interchangeably herein.

A host cell can be any prokaryotic or eukaryotic cell. For example, a Kalpa can be expressed in bacterial cells such as *E. coli*, insect cells, yeast plant cells or mammalian cells (such as Chinese hamster ovary cells (CHO) or COS cells or human cells). Other suitable host cells are known to those skilled in the art, including *Xenopus laevis* oocytes.

Vector DNA or RNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA or RNA) into a host cell, including calcium phosphate or calcium chloride co-precipitation, DEAE-dextran-mediated transfection, lipofection, or electroporation. Suitable methods for transforming or transfecting host cells can be found in Sambrook and Russell, 2001, supra, the disclosure of which is incorporated herein by reference in its entirety), and other laboratory manuals.

A host cell of the invention, such as a prokaryotic or eukaryotic host cell in culture, can be used to produce (i.e., express) a nucleic acid of the present invention. Accordingly, the invention further provides methods for producing a using the host cells of the invention. In one embodiment, the method comprises culturing the host cell of invention (into which a recombinant expression vector encoding a nucleic acid of the present invention has been introduced) in a suitable medium such that a nucleic acid of the present invention is produced. In another embodiment, the method further comprises isolating a nucleic acid of the present invention from the medium or the host cell.

The host cells of the invention can also be used to produce nonhuman transgenic animals. For example, in one embodiment, a host cell of the invention is a fertilized oocyte or an embryonic stem cell into which a nucleic acid of the present invention have been introduced. Such host cells can then be used to create non-human transgenic animals in which exogenous nucleic acid of the present invention have been introduced into their genome. Such animals are useful for studying the function and/or activity of a nucleic acid of the present invention or fragment thereof and for identifying and/or evaluating modulators of the target mRNA of a nucleic acid of the present invention. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, etc.

The invention likewise concerns animals, except man, which comprise at least one cell transformed according to the invention.

EXAMPLES

The following examples are offered to illustrate, but not to limit the claimed invention.

Example 1

Identified Pre-microRNA Sequences Using the Validation Protocol in Example 3, Below See sequences SEQ ID Nos. 1 to 1694 and 4035-5758 from the sequence listing, particularly the sequence of the pre-microRNA nucleic acid having the DNA sequence SEQ ID NOs. 3, 5, 16, 22, 32, 34, 35, 36, 60, 70, 77, 81, 82, 90, 93, 139, 141, 151, 152, 158, 163, 170, 175, 176, 183, 184, 191, 192, 200, 205, 219, 223, 224, 248, 275, 276, 323, 328, 344, 357, 363, 366, 385, 400, 406, 407, 425, 472, 481, 489, 500, 501, 503, 512, 527, 530, 531, 563, 608, 633, 640, 651, 653, 664, 678, 728, 744, 753, 784, 785, 786, 826, 832, 858, 876, 903, 909, 911, 926, 927, 940, 942, 944, 946, 947, 951, 955, 963, 967, 975, 1055, 1060, 1083, 1118, 1129, 1137, 1145, 1160, 1161, 1166, 1173, 1174, 1175, 1198, 1205, 1207, 1217, 1233, 1238, 1251, 1267, 1299, 1321, 1323, 1343, 1352, 1396, 1403, 1429, 1485, 1531, 1545, 1547, 1559, 1586, 1592, 1601, 1610, 1611, 1617, 1634, 1645, 1649, 1653, 1656, 1661, 1667, 1681, 1686, 1688, 1693 and 4773.

Example 2

Identified MicroRNA Sequences (Mature MicroRNA) Using the Validation Protocol in Example 3, Below See sequences SEQ ID Nos. 1695 to 4004 and 5759-7803 from the sequence listing, particularly the microRNA having the DNA sequences SEQ ID NOs. 1697, 1698, 1700, 1719, 1720, 1730, 1731, 1732, 1744-1750, 1784, 1785, 1805-1807, 1815-1818, 1824-1828, 1837-1839, 1842, 1843, 1896-1900, 1911-1917, 1925, 1926, 1933, 1934, 1944, 1945, 1949-1954, 1959-1964, 1975-1979, 1990-1993, 2000-2002, 2025-2027, 2068, 2108, 2111, 2112, 2173-2175, 2180, 2181, 2201-2203, 2219-2221, 2228, 2229, 2231-2237, 2260, 2278-2280, 2313, 2314, 2408-2410, 2427-2434, 2437, 2438, 2532, 2450, 2451, 2469-2471, 2476, 2477, 2613, 2620-2622, 2637, 2648, 2679, 2730, 2754-2756, 2771, 2809, 2810, 2814, 2815, 2862, 2863, 2870-2872, 2900, 2958-2961, 2966-2968, 2971-2974, 2999-3001, 3015, 3017-3019, 3021, 3023-3027, 3029, 3030, 3038, 3039, 3048-3050, 3052-3054, 3061, 3062, 3162, 3189, 3232, 3233, 3249, 3250, 3271-3274, 3300-3304, 3320-3329, 3363, 3372-3375, 3378, 3379, 3391, 3392, 3416, 3417, 3422-3424, 3440-3442, 3461, 3497-3499, 3528, 3555-3557, 3567, 3619-3621, 3627, 3628, 3663, 3786, 3804-3808, 3862, 3863, 3870, 3871, 3896-3898, 3912, 3931, 3943, 3950, 3951, 3956, 3957, 3959, 3960, 3966-3968, 3973-3976, 3986, 3987, 3991-3994, 4001-4004.

Example 3

Demonstration that Identified MicroRNAs are Transcripts Present in Cells

A) Material and Methods
Protocol for the microRNA Expression Profiling ("Validation Protocol")
Sample: Total RNA from Mouse
Total RNA from three different mouse tissues listed below were tested in a first run of microRNA expression profiling based on microRNA identification performed with RNA-gate™.
Mouse Normal Tissue Total RNA
Total RNA utilized for the test experiments was purchased from Biochain Institute Inc., Hayward, Calif., USA. The RNA quality was verified with the Agilent bioanalyser.

TABLE 2

| Tissue | cat # | Size |
|---|---|---|
| Liver | R1334149-50 | 50 µg |
| Skeletal muscle | R1334171-50 | 50 µg |
| Lung | R1334152-50 | 50 µg |
| Brain | R1334035-50 | 50 µg |
| Heart | R1334122-50 | 50 µg |

In general, RNA extraction is performed such that small RNAs are not lost. To this end commercially available kits for total RNA isolation can be utilized, such as offered by Ambion, Invitrogen and other molecular biology tool providers.
MicroRNA Enrichment
MicroRNA enrichment can be achieved by utilising the mirVANA™ miRNA isolation kit, the mirVANA™ PARIS™ kit from Ambion.
miRNA purification was performed using the below described gel purification protocol to mapp mature miRNA of about 20 nt in length. The decision not to use a commercially available kit was to diminish background noise, generated when purifying total RNA with a size inferior to 200 nt.
Protocol
1 Prepare a 15% polyacrylamide denaturing gel.
2 Polymerise for 30 min.
3 Resuspend samples in sample buffer (1:1).
4 Denature RNA samples at 95° C. for 5 min.
5 Incubate on ice until loading.
6 Preheat the gel at 400 V for 20 min in 1×TBE.
7 Clear wells from urea prior to loading.
8 Run the gel until the bromophenol blue dye front (the leading dye) migrates about 4-5 cm down the gel.
9 Cut out gel slice between both dyes (bromphenol Blue and Xylene Cyanol). Corresponds to size 60-10 nt.
10 Mix gel slice with elution buffer in an Eppendorf. The gel slice has to be entirely covered.
11 Vortex to mix.
12 Incubate at 37° C. overnight.
13 Centrifuge at Vmax for 2 min.
14 Decant Supernatant 1 into a sterile tube.
15 2nd Elution: Add same amount of elution buffer as in step ten.
16 Incubate 4 min at 95° C.
17 Centrifuge at Vmax for 2 min.
18 Decant Supernatant 2 into a sterile tube.
19 Pool both supernatants.
20 Add 05 µl glycogen at 25 mg/µl.
21 Precipitate with 3 Volumes ethanol at 99% (min. 2 hours).
22 Centrifuge for 15 min at Vmax and 4° C.
23 Wash with 70% ethanol.
24 Vacuum dry for 5 min in speed-vac.
25 Disolve pellet in 3 µl sterile Rnase-free water.

| Buffers | |
|---|---|
| 10 × TBE buffer, pH 8.0 at 25° C. | |
| Tris | 890 mM |
| Boric acid | 890 mM |
| EDTA | 20 mM |
| Denaturing Polyacrylamide Gel | |
| Polyacrylamide | 15% |
| Urea | 7M |
| Ammonium Persulfat | 0.1% |
| TEMED | 25 µl/100 ml |
| in 1 × TBE | |
| Sample buffer | |
| Formamide | 95% |
| 500 mM EDTA | 20 mM |
| Bromophenol Blue | 0.05% |
| Xylene Cyanol FF | 0.05% |
| Elution buffer | |
| Sodium Acetate | 500 mM |
| EDTA | 1 mM |

Sample Labeling
Samples were labeled Cy3 and/or Cy5 using the mirVana™ miRNA labeling kit from Ambion
Microarray
Probe Design
The oligonucleotides were designed according to SEQ ID NOs: 77, 139, 223, 328, 728, 832, 858, 951, 963, 1083, 1173, 1205, 1429, 1611, 1617, 1649, 1688 and to *A. thaliana* microRNA sequence named ath-MIR156a, ath-MIR157 as negative control (the precursor sequence of both are not present in the human genome).
Probe was designed using the protocol below:
1) extracting both the 5' stem and the 3' stem of the precursor microRNA
As used herein, the oligonucleotide coming from the 5' end stem is called SEQ ID-L1, and oligonucleotide coming from the 3' end is called SEQ ID —R1;

2) check the longest sequence for both which is fully conserved with mouse genome for the oligonucleotide R1 and L1;
3) if sequence (R or L) length <=18 nt; remove it
if length<35; catch sequence
if 45>length>=35; design 2 sequences (named -1/-2) with a minimum coverage of 24 nucleotides catch sequences else,
make sequences with a walk of 10 nucleotides to cover all the sequence,
catch sequences;
4) reverse complement sequence;
5) add a spacer (15 nt) on 5' of the sequence.

Reverse complement sequences from design without spacer are SEQ ID 1815, 1896, 2026, 2180, 2181, 2730, 2870, 2871, 2872, 2900, 3029, 3050, 3189, 3322, 3374, 3663, 3912, 3951, 3993, 4004.

Following is an example of oligonucleotide design for SEQ ID 77.

Example: Oligonucleotide Design for SEQ ID 77:

```
                                            (SEQ ID NO: 7805)
5'    CAG      GA   A  GAGAA-    UU     C  A
   AUGG   AGAUAUU  CAU GU     AACA  GCCUU   A
   UACC   UCUGUAA  GUG CA     UUGU  CGGGA   C
3'    AGA      A-   A  AAACAG    UU     UAA
```

Sequence L1=5' stem
>77-L1

```
                                        (SEQ ID NO: 7822)
ATGGCAGAGATATTGACATAGTGAGAAAACATT
``` conservation of sequence L1 with mouse:

```
                                                (SEQ ID NO: 7823)
human ATGGCAGAGATATTGACATAGTGAGAAAACATTGCCTT
                                                (SEQ ID NO: 7824)
mouse ATGGCAGAGATATTGACATAGTGAGAAAACATTGCTTT
      ************************************** **
``` sequence to use to design oligonucleotide:

```
                                        (SEQ ID NO: 7825)
ATGGCAGAGATATTGACATAGTGAGAAAACATTGC
```

Length of this sequence is 35 nt, so 2 oligonucleotides for this 77-L1 with a minimum of coverage of 24 nucleotides:

```
                                        (SEQ ID NO: 1817)
L1-2     cagagatattgacatagtgagaaaacattgc
                                        (SEQ ID NO: 1818)
L1-1  atggcagagatattgacatagtgagaaaa
``` reverse complement of the 2 oligos to obtain oligonucleotides:

```
                                           (SEQ ID NO: 7826)
77-L1-1:   TTTTCTCACTATGTCAATATCTCTGCCAT
                                           (SEQ ID NO: 7827)
77-L2-2:   GCAATGTTTTCTCACTATGTCAATATCTCTG
```

Sequence R1=3' stem
>77-R1

```
                                           (SEQ ID NO: 7828)
AGGGCTTTGTTGACAAAACAGTGAAATGTCTAGACCAT
``` conservation of sequence R1 with mouse:

```
                                                (SEQ ID NO: 7828)
human AGGGCTTTGTTGACAAAACAGTGAAATGTCTAGACCAT
                                                (SEQ ID NO: 7828)
mouse AGGGCTTTGTTGACAAAACAGTGAAATGTCTAGACCAT
      **************************************
``` sequence to use to design oligo:

```
                                           (SEQ ID NO: 7828)
AGGGCTTTGTTGACAAAACAGTGAAATGTCTAGACCAT
``` length of this sequence is 35 nt, so 2 oligos for this 77-L1 with a minimum of coverage of 24 nucleotides:

```
                                         (SEQ ID NO: 1815)
R1-2     tttgttgacaaaacagtgaaatgtctagaccat
                                         (SEQ ID NO: 1816)
R1-1  agggctttgttgacaaaacagtgaaatgtc
``` reverse complement of the 2 oligos to obtain oligonucleotides:

```
                                              (SEQ ID NO: 7829)
77-R1-1:   AGACATTTCACTGTTTTGTCAACAAAGCCCT
                                              (SEQ ID NO: 7830)
77-R1-2:   ATGGTCTAGACATTTCACTGTTTTGTCAACAAA
``` add spacer to all designed oligonucleotides (TTG-TAATACGACTCA; SEQ ID NO:7831) on 5':

```
77-L1-1:                                      (SEQ ID NO: 7832)
TTGTAATACGACTCATTTTCTCACTATGTCAATATCTCTGCCAT

77-L1-2:                                      (SEQ ID NO: 7833)
TTGTAATACGACTCAGCAATGTTTTCTCACTATGTCAATATCTCTG

77-R1-1:                                      (SEQ ID NO: 7834)
TTGTAATACGACTCAAGACATTTCACTGTTTTGTCAACAAAGCCCT

77-R1-2:                                      (SEQ ID NO: 7835)
TTGTAATACGACTCAATGGTCTAGACATTTCACTGTTTTGTCAACAAA
```

See Table 3 for the sequence of OLIGO design.

TABLE 3

OLIGO design

| OLIGO NAME | SEQ ID NO: | SEQUENCE (SEQ ID Nos. 4005 to 4034) |
|---|---|---|
| 77-R1-2(10303-R1-2)* | 4005 | TTGTAATACGACTCAATG-GTCT AGACATTTCACTGTTTTGT-CAA CAAA |
| 139-R1-1(10553-R1-1) | 4006 | TTGTAATACGACTCAGCTG-GCT CCATGCTCCAGTGGG |

TABLE 3-continued

OLIGO design

| OLIGO NAME | SEQ ID NO: | SEQUENCE (SEQ ID Nos. 4005 to 4034) |
|---|---|---|
| 223-R1-2(3926-R1-2) | 4007 | TTGTAATACGACTCAATGGGAG GTTTTGCTATCAA GAAATCTAA TGAGG |
| 328-R1-1(4303-R1-1) | 4008 | TTGTAATACGACTCAAGTGCCC GCTCCTCCGACCTCCCT GCGCA CC |
| 328-R1-2(4303-R1-2) | 4009 | TTGTAATACGACTCAGGGTGGG CAGTGCCCGCTCCTCCGACCTC CCTG |
| 728-R1-1(5795-R1-1) | 4010 | TTGTAATACGACTCACTGCCCT CCAAGAAATAAATTACCCGCAA TTACT |
| 832-L1-1(6216-L1-1) | 4011 | TTGTAATACGACTCAGACATTC AGAGCACTGGGCAGAAATCACA TG |
| 832-L1-2(6216-L1-2) | 4012 | TTGTAATACGACTCATTCACTT TGACATTCAGAGCACTGGGCAG AAAT |
| 832-R1-1(6216-R1-1) | 4013 | TTGTAATACGACTCATAGTTAC TCCCGCCGTTTACCCGTG |
| 858-L1-1(6328-L1-1) | 4014 | TTGTAATACGACTCACACAGAC CTGGAACCTTCAAAAGCAGTA |
| 951-L1-1(6692-L1-1) | 4015 | TTGTAATACGACTCATTTAAGT ACCAAATTTGTCACTC |
| 963-R1-1(6752-R1-1) | 4016 | TTGTAATACGACTCACCCTCCT TTCCCCACCTCAGT |
| 1083-L1-1(7221-L1-1) | 4017 | TTGTAATACGACTCAACCTGCC AGGAAGGTGGGGCGTGGCAGA GGGG |
| 1173-L1-1(7571-L1-1) | 4018 | TTGTAATACGACTCAAGGGCTC CCCCACCCCTAAG |
| 1205-R1-1(7747-R1-1) | 4019 | TTGTAATACGACTCAAATTGCA AATATGCATTTAAATTTAATAA TAC |
| 1429-L1-1(8736-L1-1) | 4020 | TTGTAATACGACTCAACTGGCT CACCTCTAATCACAACCTGCCT GCATT |
| 1611-L1-1(9627-L1-1) | 4021 | TTGTAATACGACTCATTCACTT TCCCTGTGTTAGCTAATGATGC |
| 1617-L1-1(9644-L1-1) | 4022 | TTGTAATACGACTCAGTCAAAA CCCTTCAGGTCCACT |
| 1649-R1-1(9753-R1-1) | 4023 | TTGTAATACGACTCACTCGATT AAACAACAGATACCACTTACAG AC |
| 1688-R1-1(9955-R1-1) | 4024 | TTGTAATACGACTCAGAGCTGC AGACCCCATGCCAATCCATAGC |
| ath-MIR156a-L-1 | 4025 | TTGTAATACGACTCATTGCCTT TGTGTGCTCACTCTCTTCTGTC AG |
| ath-MIR156a-L-2 | 4026 | TTGTAATACGACTCATGCAAAT TGCCTTTGTGTGCTCACTCTCT TC |
| ath-MIR156a-R-1 | 4027 | TTGTAATACGACTCAGAGCAGT GAGCACGCAAGAGAAGCAAGTG CA |
| ath-MIR156a-R-2 | 4028 | TTGTAATACGACTCACTGACAG AAAGAGCAGTGAGCACGCAAGA GAAGCA |
| ath-MIR157a-L-1 | 4029 | TTGTAATACGACTCATCTCATC ATCTGTGCTCTCTATCTTCTGT CAACAC |
| ath-MIR157a-L-2 | 4030 | TTGTAATACGACTCACCGAATT GTATCTCATCATCTGTGCTCTC TATCTT |
| ath-MIR157a-L-3 | 4031 | TTGTAATACGACTCACTCCGAA TTGTATCTCATCATCTGTGC |
| ath-MIR157a-R-1 | 4032 | TTGTAATACGACTCAAGGCTAG AGAGCACAAAGGAGTAAGATGC AAAGAA |
| ath-MIR157a-R-2 | 4033 | TTGTAATACGACTCATGATGAC AGAAGGCTAGAGAGCACAAAGG AGTAAG |

TABLE 3-continued

OLIGO design

| OLIGO NAME | SEQ ID NO: | SEQUENCE (SEQ ID Nos. 4005 to 4034) |
|---|---|---|
| MUSTRP2 | 4034 | TTGTAATACGACTCATCG-CACC CAAAGCGAGAATCATAC-CCCTA GACCAACGAGC |

*In the wording "77-R1-2 (10303-R1-2)" for OLIGO NAME, the term in brackets 10303-R1-2 corresponds to the reference used for the name the oligonucleotide probe in Table 4.
The number "77" in the term 77-R1-2 corresponds to the number of the corresponding pre-miRNA SEQ ID NO:.

Each specific mapping sequence is preceded by a spacer sequence of 15 nt. This spacer sequence serves to prevent non-specific interactions of the oligonucleotides with the array support. The oligonucleotides are amino-modified at their 5' end to allow their fixing onto the array support.

Oligonucleotide Synthesis

The probes to be spotted onto the array were synthesized according to standard protocols from Operon Biotechnologies, Cologne, Germany, specialised in the synthesis of modified oligonucleotide.

Array Support

As support for the microarray the Nexterion microarray glass slides from Schott were utilised.

Spotting

Probe concentration is 50 μmol for each probe. The probes were spotted using the Nexterion spotting buffer+1% SDS (Sodium dodecyl sulfate) provided by Schott with the array glass support. 1% SDS was added to allow larger spots (e.g. 100-150 micron compared to 70-100 micron without SDS).

The spotter utilized was the Q array mini from Gentix. After the deposit of 1 series of spots the spotting needle was washed 5× before spotting the next series of probes. Spotted glass slides were kept at 4° C. until use.

Hybridization

Protocol

1 Prehybridize the slide with Prehybridization buffer for 30 min at 42° C.
2 Dip the slide into sterile water.
3 Dip the slide into isopropanol.
4 Dry the slide.
5 Heat the hybridization buffer up to 65° C. for 5 min immediately before use.
6 Add 3×miRNA hybridization buffer to the labeled miRNA sample (final concentration: 1×).
7 Heat the miRNA hybridization mixture to 95° C. for 3 min, then briefly centrifuge.
8 Transfer the miRNA hybridization mixture to a microarray. Be careful to avoid bubbles when placing the cover slip.
9 Place the array into a hybridization cassette (coming chamber). Add diluted salt to maintain humidity in the chamber.
10 Incubate 42° C. for 12-16 hr.
11 Remove the array from the cassette and submerge it in low stringency wash solution at room temperature for 1 min under agitation. The cover slip will disengage from the slide.
12 Transfer the array to a second low stringency wash solution for 1 min. under agitation.
13 Transfer the array to a high stringency wash solution for 1 min under agitation.
14 Dip the slide into water.
15 Dip the slide into isopropanol.
16 Dry the slide.

Buffers
Prehybridization Buffer
  3×SSC
  0.1% SDS
  10 mg/ml Salmon sperm DNA
3×miRNA Hybridization Buffer
  Solution delivered with mirVana Probe set kit Ambion
Washing Solution
  Solutions delivered with mirVana Probe set kit Ambion
  Low stringency wash solution: 940 ml water
  10 ml detergent concentrate from Ambion
  50 ml Salt concentrate from Ambion
  High stringency wash solution: 995 ml water
Image Acquisition
  Name of the Scanner: Fluoroskan Ascent (Labsystem)
  The digital images are acquired from the Axon scanner using the software Genepix. The image is formatted in tif format, defined by an image color depth of 16 bits/pixel (1600*1600). Pixels can have intensities values ranging from 0 to 65,535. Pixels exhibiting the maximum intensity value are "saturated" assigned the value 65,535.
  Resolution: Scan array at 10 μm/px
  Settings: For hybridization experiments using different fluorescent dyes (e.g Cy5 and Cy3) the photomultiplier tube (PMT) is adjusted to the higher intensity spot. Cy3 is scanned at lower PMT settings.
Image Analysis
  A photo-multiplier of a laser scanner digitizes a captured fluorescence for a given "point" of a slide (or screen) and stores a numerical value in a pixel corresponding to that point. A picture composed of such pixels is analyzed during image analysis.
  First task for image analysis is to detect the spot position and limits. This stage is often called segmentation. Usually spots are segmented by circles of adaptable or fixed radius. To be reliably segmented and quantified, the spot diameter should be more than 5-6 pixels. Before segmentation an indexing grid is provided giving approximate positions of spots. The segmentation itself detects the limits of spots near the grid nodes. The segmentation must be conducted in rather flexible way because of spotting imperfection or support deformation. Put in other way, the spots lye almost never on perfect rectangular grid.
  The second task of image analysis is to quantify spots and export data in a result file. This is relatively easy and well defined task once the spots were determined on the image. Statistics most frequently used to quantify spot intensity are the mean or median of pixels belonging to a spot. Median is more robust than mean value in presence of outlier pixels. In practice, however, there are little differences in results obtained using mean or median.
miRNA Array Prehybridization
  Incubated the miRNA array in a solution: 3×SSC, SDS 0.1%, 1% (V/V) salmon sperm at 10 mg/ml for 30 min at 42° C., then wash the slide by dipping them in water, then isopropanol and dry the slide before the hybridization.
miRNA Array Hybridization
  Heat the 3×miRNA hybridization buffer to 65° C. for 5 min immediately before use to dissolve it completely.
  Add 3×miRNA hybridization buffer to the labeled miRNA sample for a final 1× concentration of miRNA hybridization buffer.
  Heat the miRNA hybridization mixture to 95° C. for 3 min, then briefly centrifuge.
  Transfer the miRNA hybridization mixture to a microarray. Be careful to the bubble Place the array into a hybridization cassette (coming chamber). Add diluted salt to maintain humidity in the chamber.
Incubate 42° C. for 12-16 hrs.

Washing

Remove the hybridized miRNA array from the cassette and submerge it in Low stringency wash at room temperature for 1 min under agitation. The cover slip will disengage from the slide.

Transfer the hybridized miRNA array to a second low stringency wash clean slide holder for 1 min under agitation.

Then transfer the hybridized miRNA array to a high stringency wash clean slide holder for 1 min. under agitation.

Dip the slide into water, than isopropanol and dry the slide.

Low stringency wash solution: 940 ml water
  10 ml detergent concentrate from Ambion
  50 ml Salt concentrate from Ambion High stringency wash solution: 995 ml water
  5 ml Salt concentrate from Ambion Results Tables 4, 5 and 6 demonstrate the presence of the microRNA transcripts identified by the present methods in cells of different tissues.

TABLE 4

| TESTED TISSUES | Well | OLIGO NAME | Position Row/column | | Intensity | SEQ ID precursor | SEQ ID mature |
|---|---|---|---|---|---|---|---|
| LUNG | 2B13 | MUSTRP2 | 19 | 5 | 0.61 | Positive control | |
| | 2B13 | MUSTRP2 | 20 | 5 | 0.55 | Positive control | |
| | 2A20 | ath-MIR156a-L-1 | 9 | 41 | −0.92 | Negative control | |
| | 2A21 | ath-MIR156a-L-2 | 11 | 5 | −0.88 | Negative control | |
| | 2B2 | ath-MIR157a-L-3 | 14 | 17 | −0.72 | Negative control | |
| | 2B4 | ath-MIR157a-R-2 | 14 | 41 | −0.67 | Negative control | |
| | 2D22 | 10553-R1-1 | 47 | 17 | −0.39 | 139 | 1896 |
| | 2D22 | 10553-R1-1 | 48 | 17 | −0.35 | 139 | 1896 |
| | 2G4 | 4303-R1-1 | 25 | 42 | −0.06 | 328 | 2180 |
| | 2G4 | 4303-R1-1 | 26 | 42 | −0.06 | 328 | 2180 |
| | 2G5 | 4303-R1-2 | 27 | 6 | −0.4 | 328 | 2181 |
| | 2G5 | 4303-R1-2 | 28 | 6 | −0.53 | 328 | 2181 |
| | 2K7 | 5795-R1-1 | 27 | 31 | −0.6 | 728 | 2730 |
| | 2K7 | 5795-R1-1 | 28 | 31 | −0.57 | 728 | 2730 |
| | 2L4 | 6216-L1-1 | 37 | 43 | 1.52 | 832 | 2870 |
| | 2L4 | 6216-L1-1 | 38 | 43 | 1.54 | 832 | 2870 |
| | 2L5 | 6216-L1-2 | 39 | 7 | 1.6 | 832 | 2871 |
| | 2L5 | 6216-L1-2 | 40 | 7 | 1.61 | 832 | 2871 |
| | 2L6 | 6216-R1-1 | 39 | 19 | 1.91 | 832 | 2872 |
| | 2L6 | 6216-R1-1 | 40 | 19 | 1.88 | 832 | 2872 |
| | 2N9 | 6752-R1-1 | 17 | 8 | 0.73 | 963 | 3050 |
| | 2N9 | 6752-R1-1 | 18 | 8 | 0.7 | 963 | 3050 |
| | 2O19 | 7571-L1-1 | 33 | 32 | −0.14 | 1173 | 3322 |
| | 2O19 | 7571-L1-1 | 34 | 32 | −0.15 | 1173 | 3322 |
| | 3C16 | 9627-L1-1 | 31 | 45 | −0.61 | 1611 | 4004 |
| | 3C16 | 9627-L1-1 | 32 | 45 | −0.54 | 1611 | 4004 |
| | 3D7 | 9955-R1-1 | 39 | 33 | −0.76 | 1688 | 3993 |
| | 3D7 | 9955-R1-1 | 40 | 33 | −0.6 | 1688 | 3993 |
| MUSCLE | 2B13 | MUSTRP2 | 19 | 5 | 0.16 | Positive control | |
| | 2B13 | MUSTRP2 | 20 | 5 | 0.21 | Positive control | |
| | 2A21 | ath-MIR156a-L-2 | 12 | 5 | −0.11 | Negative control | |
| | 2B2 | ath-MIR157a-L-3 | 13 | 17 | −0.42 | Negative control | |
| | 2B1 | ath-MIR157a-L-2 | 14 | 5 | −0.43 | Negative control | |
| | 2B3 | ath-MIR157a-R-1 | 13 | 29 | −0.58 | Negative control | |
| | 2A21 | ath-MIR156a-L-2 | 11 | 5 | −0.65 | Negative control | |
| | 2B1 | ath-MIR157a-L-2 | 13 | 5 | −1.01 | Negative control | |
| | 2D22 | 10553-R1-1 | 47 | 17 | 0.08 | 139 | 1896 |
| | 2D22 | 10553-R1-1 | 48 | 17 | 0.03 | 139 | 1896 |
| | 2G4 | 4303-R1-1 | 25 | 42 | 0.48 | 328 | 2180 |
| | 2G4 | 4303-R1-1 | 26 | 42 | 0.47 | 328 | 2180 |
| | 2G5 | 4303-R1-2 | 27 | 6 | 0.02 | 328 | 2181 |
| | 2G5 | 4303-R1-2 | 28 | 6 | −0.03 | 328 | 2181 |
| | 2K7 | 5795-R1-1 | 27 | 31 | −0.05 | 728 | 2730 |
| | 2K7 | 5795-R1-1 | 28 | 31 | −0.01 | 728 | 2730 |
| | 2L4 | 6216-L1-1 | 37 | 43 | 1.99 | 832 | 2872 |
| | 2L4 | 6216-L1-1 | 38 | 43 | 2.04 | 832 | 2872 |
| | 2L5 | 6216-L1-2 | 39 | 7 | 1.98 | 832 | 2872 |
| | 2L5 | 6216-L1-2 | 40 | 7 | 1.98 | 832 | 2872 |
| | 2L6 | 6216-R1-1 | 39 | 19 | 2.26 | 832 | 2872 |
| | 2L6 | 6216-R1-1 | 40 | 19 | 2.25 | 832 | 2872 |
| | 2N9 | 6752-R1-1 | 17 | 8 | 1.03 | 963 | 3050 |
| | 2N9 | 6752-R1-1 | 18 | 8 | 1.01 | 963 | 3050 |
| | 2O19 | 7571-L1-1 | 33 | 32 | 0.02 | 1173 | 3322 |
| | 2O19 | 7571-L1-1 | 34 | 32 | 0.08 | 1173 | 3322 |
| | 3C17 | 9644-L1-1 | 33 | 9 | −0.04 | 1617 | 3912 |
| | 3C17 | 9644-L1-1 | 34 | 9 | −0.04 | 1617 | 3912 |
| LIVER | 2B13 | MUSTRP2 | 19 | 5 | 0.21 | Positive control | |
| | 2B13 | MUSTRP2 | 20 | 5 | 0.21 | Positive control | |
| | 2B2 | ath-MIR157a-L-3 | 13 | 17 | −0.1 | Negative control | |
| | 2B1 | ath-MIR157a-L-2 | 14 | 5 | −0.24 | Negative control | |
| | 2A21 | ath-MIR156a-L-2 | 12 | 5 | −0.33 | Negative control | |
| | 2B3 | ath-MIR157a-R-1 | 14 | 29 | −0.41 | Negative control | |

TABLE 4-continued

| TESTED TISSUES | Well | OLIGO NAME | Position Row/column | | Intensity | SEQ ID precursor | SEQ ID mature |
|---|---|---|---|---|---|---|---|
| | 2A23 | ath-MIR156a-R-2 | 11 | 29 | −0.57 | Negative control | |
| | 2A22 | ath-MIR156a-R-1 | 12 | 17 | −0.63 | Negative control | |
| | 2B1 | ath-MIR157a-L-2 | 13 | 5 | −0.65 | Negative control | |
| | 2D22 | 10553-R1-1 | 47 | 17 | 0.04 | 139 | 1896 |
| | 2D22 | 10553-R1-1 | 48 | 17 | 0.01 | 139 | 1896 |
| | 2G4 | 4303-R1-1 | 25 | 42 | 0.26 | 328 | 2180 |
| | 2G4 | 4303-R1-1 | 26 | 42 | 0.21 | 328 | 2180 |
| | 2L4 | 6216-L1-1 | 37 | 43 | 2.09 | 832 | 2872 |
| | 2L4 | 6216-L1-1 | 38 | 43 | 2.09 | 832 | 2872 |
| | 2L5 | 6216-L1-2 | 39 | 7 | 2.14 | 832 | 2872 |
| | 2L5 | 6216-L1-2 | 40 | 7 | 2.16 | 832 | 2872 |
| | 2L6 | 6216-R1-1 | 39 | 19 | 2.48 | 832 | 2872 |
| | 2L6 | 6216-R1-1 | 40 | 19 | 2.47 | 832 | 2872 |
| | 2N21 | 7221-L1-1 | 23 | 8 | 0.12 | 1083 | 3189 |
| | 2N21 | 7221-L1-1 | 24 | 8 | 0.08 | 1083 | 3189 |
| | 2N9 | 6752-R1-1 | 17 | 8 | 1.15 | 963 | 3050 |
| | 2N9 | 6752-R1-1 | 18 | 8 | 1.13 | 963 | 3050 |
| | 2O19 | 7571-L1-1 | 33 | 32 | 0.04 | 1173 | 3322 |
| | 2O19 | 7571-L1-1 | 34 | 32 | 0.03 | 1173 | 3322 |
| | 3B5 | 8736-L1-1 | 15 | 9 | −0.01 | 1429 | 3663 |
| | 3B5 | 8736-L1-1 | 16 | 9 | 0.04 | 1429 | 3663 |
| HEART_BRAIN Cy5 | 2B13 | MUSTRP2 | 19 | 5 | 0.93 | Positive control | |
| | 2B13 | MUSTRP2 | 20 | 5 | 0.81 | Positive control | |
| | 2B2 | ath-MIR157a-L-3 | 14 | 17 | −0.01 | Negative control | |
| | 2B2 | ath-MIR157a-L-3 | 13 | 17 | −0.18 | Negative control | |
| | 2A21 | ath-MIR156a-L-2 | 11 | 5 | −0.22 | Negative control | |
| | 2B1 | ath-MIR157a-L-2 | 13 | 5 | −0.23 | Negative control | |
| | 2A24 | ath-MIR157a-L-1 | 11 | 41 | −0.26 | Negative control | |
| | 2A21 | ath-MIR156a-L-2 | 12 | 5 | −0.29 | Negative control | |
| | 2B4 | ath-MIR157a-R-2 | 13 | 41 | −0.31 | Negative control | |
| | 2A23 | ath-MIR156a-R-2 | 12 | 29 | −0.31 | Negative control | |
| | 2B3 | ath-MIR157a-R-1 | 13 | 29 | −0.31 | Negative control | |
| | 2A23 | ath-MIR156a-R-2 | 11 | 29 | −0.38 | Negative control | |
| | 2B1 | ath-MIR157a-L-2 | 14 | 5 | −0.38 | Negative control | |
| | 2A20 | ath-MIR156a-L-1 | 9 | 41 | −0.41 | Negative control | |
| | 2A20 | ath-MIR156a-L-1 | 10 | 41 | −0.41 | Negative control | |
| | 2B4 | ath-MIR157a-R-2 | 14 | 41 | −0.43 | Negative control | |
| | 2A22 | ath-MIR156a-R-1 | 11 | 17 | −0.45 | Negative control | |
| | 2G4 | 4303-R1-1 | 25 | 42 | 0.26 | 328 | 2180 |
| | 2G4 | 4303-R1-1 | 26 | 42 | 0.3 | 328 | 2180 |
| | 2G5 | 4303-R1-2 | 27 | 6 | 0.02 | 328 | 2181 |
| | 2G5 | 4303-R1-2 | 28 | 6 | 0.02 | 328 | 2181 |
| | 2L4 | 6216-L1-1 | 37 | 43 | 2.08 | 832 | 2872 |
| | 2L4 | 6216-L1-1 | 38 | 43 | 2.09 | 832 | 2872 |
| | 2L5 | 6216-L1-2 | 39 | 7 | 2.04 | 832 | 2872 |
| | 2L5 | 6216-L1-2 | 40 | 7 | 2.06 | 832 | 2872 |
| | 2L6 | 6216-R1-1 | 39 | 19 | 2.4 | 832 | 2872 |
| | 2L6 | 6216-R1-1 | 40 | 19 | 2.42 | 832 | 2872 |
| | 2L8 | 6328-L1-1 | 39 | 43 | 0.4 | 858 | 2900 |
| | 2L8 | 6328-L1-1 | 40 | 43 | 0.07 | 858 | 2900 |
| | 2N3 | 6692-L1-1 | 13 | 32 | −0 | 951 | 3029 |
| | 2N3 | 6692-L1-1 | 14 | 32 | 0.03 | 951 | 3029 |
| | 2N9 | 6752-R1-1 | 17 | 8 | 1.09 | 963 | 3050 |
| | 2N9 | 6752-R1-1 | 18 | 8 | 1.04 | 963 | 3050 |
| | 2O19 | 7571-L1-1 | 33 | 32 | 0.15 | 1173 | 3322 |
| | 2O19 | 7571-L1-1 | 34 | 32 | 0.09 | 1173 | 3322 |
| HEART_BRAIN Cy3 | 2B13 | MUSTRP2 | 19 | 5 | 0.18 | Positive control | |
| | 2B13 | MUSTRP2 | 20 | 5 | 0.09 | Positive control | |
| | 2B3 | ath-MIR157a-R-1 | 13 | 29 | −0.21 | Negative control | |
| | 2B4 | ath-MIR157a-R-2 | 13 | 41 | −0.25 | Negative control | |
| | 2B1 | ath-MIR157a-L-2 | 14 | 5 | −0.31 | Negative control | |
| | 2A24 | ath-MIR157a-L-1 | 12 | 41 | −0.32 | Negative control | |
| | 2A24 | ath-MIR157a-L-1 | 11 | 41 | −0.33 | Negative control | |
| | 2B2 | ath-MIR157a-L-3 | 14 | 17 | −0.34 | Negative control | |
| | 2B3 | ath-MIR157a-R-1 | 14 | 29 | −0.35 | Negative control | |
| | 2B1 | ath-MIR157a-L-2 | 13 | 5 | −0.39 | Negative control | |
| | 2B2 | ath-MIR157a-L-3 | 13 | 17 | −0.41 | Negative control | |
| | 2A23 | ath-MIR156a-R-2 | 11 | 29 | −0.45 | Negative control | |
| | 2A23 | ath-MIR156a-R-2 | 12 | 29 | −0.46 | Negative control | |
| | 2A21 | ath-MIR156a-L-2 | 12 | 5 | −0.67 | Negative control | |
| | 2D1 | 10303-R1-2 | 37 | 5 | −0.2 | 77 | 1815 |
| | 2D1 | 10303-R1-2 | 38 | 5 | −0.16 | 77 | 1815 |
| | 2F2 | 3926-R1-2 | 13 | 18 | −0.17 | 223 | 2026 |
| | 2F2 | 3926-R1-2 | 14 | 18 | −0.19 | 223 | 2026 |
| | 2G4 | 4303-R1-1 | 25 | 42 | −0.04 | 328 | 2180 |
| | 2G4 | 4303-R1-1 | 26 | 42 | 0.02 | 328 | 2180 |
| | 2L4 | 6216-L1-1 | 37 | 43 | 1.44 | 832 | 2872 |

TABLE 4-continued

| TESTED TISSUES | Well | OLIGO NAME | Position Row/column | | Intensity | SEQ ID precursor | SEQ ID mature |
|---|---|---|---|---|---|---|---|
| | 2L4 | 6216-L1-1 | 38 | 43 | 1.44 | 832 | 2872 |
| | 2L5 | 6216-L1-2 | 39 | 7 | 1.47 | 832 | 2872 |
| | 2L5 | 6216-L1-2 | 40 | 7 | 1.45 | 832 | 2872 |
| | 2L6 | 6216-R1-1 | 39 | 19 | 1.8 | 832 | 2872 |
| | 2L6 | 6216-R1-1 | 40 | 19 | 1.83 | 832 | 2872 |
| | 2N9 | 6752-R1-1 | 17 | 8 | 0.48 | 963 | 3050 |
| | 2N9 | 6752-R1-1 | 18 | 8 | 0.5 | 963 | 3050 |
| | 2O19 | 7571-L1-1 | 33 | 32 | −0.16 | 1173 | 3322 |
| | 2O19 | 7571-L1-1 | 34 | 32 | −0.15 | 1173 | 3322 |
| | 2P2 | 7747-R1-1 | 37 | 20 | −0.1 | 1205 | 3374 |
| | 2P2 | 7747-R1-1 | 38 | 20 | −0.14 | 1205 | 3374 |
| | 3D3 | 9753-R1-1 | 37 | 33 | −0.19 | 1649 | 3951 |
| | 3D3 | 9753-R1-1 | 38 | 33 | −0.12 | 1649 | 3951 |

TABLE 5

Validated pre-microRNA Sequences

| SEQ ID NO: | OLIGO ID. | Tissue of Validation |
|---|---|---|
| 3 | 8587-R2-1 | Commercial prostate cell line androgen independent (Cline 2 and 3) |
| | 8587-R2-2 | Commercial prostate cell line immortalized (Cline 5) |
| | 10010-R2-1 | muscle after insulin injection (CTRav) |
| | 10010-R2-2 | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal (Cline 7) |
| | | T cells control |
| | | T cells treated with synthetic androgen "R1881" |
| | | Total prostate RNA (Cline 1) |
| | | Th1 |
| 5 | 10018-L1-1 | Th1eH |
| | | Th2eH |
| 16 | 10058-R1-1 | Th1eH |
| 22 | 10093-L2-1 | Commercial prostate cell line androgen dependent (Cline 4) |
| | 10093-R2-1 | Commercial prostate cell line androgen independent (Cline 2 and 3) |
| | 10093-R2-2 | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 32 | 10138-L2-1 | Commercial prostate cell line androgen dependent (Cline 4) |
| | 10138-L2-2 | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 34 | 10145-L2-1 | T cells control |
| | | T cells treated with synthetic androgen "R1881" |
| | | Total prostate RNA (Cline 1) |
| 35 | 10149-R1-1 | bone_marrow |
| | | Th1eH |
| | | Th2eH |
| 36 | 10154-R1-1 | fat |
| | | testes |
| 60 | 10233-L2-2 | T cells treated with synthetic androgen "R1881" |

TABLE 5-continued

Validated pre-microRNA Sequences

| SEQ ID NO: | OLIGO ID. | Tissue of Validation |
|---|---|---|
| 70 | 10273-L1-1 | Th1eH |
|  | 10273-R1-2 | Th1lH |
|  |  | Th2eH |
|  |  | Th2lH |
| 77 | 10303-L1-1 | Th2eM |
| 81 | 10324-L1-1 | Th1eH |
|  | 10324-L1-2 | Th2eM |
| 82 | 10325-R2-1 | T cells treated with synthetic androgen "R1881" |
| 90 | 10342-R2-2 | Commercial prostate cell line androgen dependent (Cline 4) |
|  |  | Commercial prostate cell line androgen independent (Cline 2 and 3) |
|  |  | Commercial prostate cell line immortalized (Cline 5) |
|  |  | Prostate primary cell line cancer (Cline 8) |
|  |  | T cells control |
|  |  | T cells treated with synthetic androgen "R1881" |
|  |  | Total prostate RNA (Cline 1) |
| 93 | 10347-L1-2 | Th1eH |
|  |  | Th2eH |
| 139 | 10553-L1-1 | Th1lH |
|  | 10553-R1-1 | Th2lH |
|  |  | brain |
|  |  | Commercial prostate cell line androgen dependent (Cline 4) |
|  |  | Commercial prostate cell line androgen independent (Cline 2 and 3) |
|  |  | Commercial prostate cell line immortalized (Cline 5) |
|  |  | GFP.RV |
|  |  | kidney |
|  |  | muscle after insulin injection (CTRav) |
|  |  | muscle before insulin injection (CTRav) |
|  |  | Prostate primary cell line cancer (Cline 8) |
|  |  | Prostate primary cell line normal (Cline 7) |
|  |  | RVp |
|  |  | RV.Tbet |
|  |  | spleen |
|  |  | T cells control |
|  |  | T cells treated with synthetic androgen "R1881" |
|  |  | testes |
|  |  | Thymocytes |
|  |  | thymus |
|  |  | Total prostate RNA (Cline 1) |
| 141 | 10562-L1-1 | Th1lH |
|  | 10562-L1-2 | Th2eM |
|  |  | Th2lH |
|  |  | Th2lH |
| 151 | 10615-L1-1 | Th2lH |
|  | 10615-L1-2 | Th1lH |
|  | 10615-R1-1 | Th2eM |
| 152 | 10617-R1-1 | Th1lH |
|  |  | Th2lH |
| 158 | 4155-L1-1 | Th1eM |
| 163 | 3717-L2-1 | Commercial prostate cell line androgen dependent (Cline 4) |
|  |  | Commercial prostate cell line androgen independent (Cline 2 and 3) |
|  |  | Commercial prostate cell line immortalized (Cline 5) |
|  |  | muscle after insulin injection (CTRav) |
|  |  | muscle after insulin injection to diabetic subject (DIABav) |
|  |  | muscle before insulin injection (CTRav) |
|  |  | muscle before insulin injection to diabetic subject (DIABav) |
|  |  | Prostate primary cell line cancer (Cline 8) |
|  |  | Prostate primary cell line normal + cancer (Cline 6) |
|  |  | Prostate primary cell line normal (Cline 7) |
|  |  | T cells control |
|  |  | T cells treated with synthetic androgen "R1881" |
|  |  | Th1 |
|  |  | Total prostate RNA (Cline 1) |
| 170 | 3740-R1-1 | Th2lH |
| 175 | 3755-L1-2 | Th1lH |
|  |  | Th2eH |
|  |  | Th2eM |
|  |  | Th2lH |
| 176 | 3758-R2-2 | Commercial prostate cell line androgen dependent (Cline 4) |
|  |  | Commercial prostate cell line androgen independent (Cline 2 and 3) |
|  |  | Commercial prostate cell line immortalized (Cline 5) |
|  |  | muscle after insulin injection (CTRav) |
|  |  | muscle after insulin injection to diabetic subject (DIABav) |
|  |  | muscle before insulin injection (CTRav) |
|  |  | muscle before insulin injection to diabetic subject (DIABav) |
|  |  | Prostate primary cell line cancer (Cline 8) |
|  |  | Prostate primary cell line normal + cancer (Cline 6) |

TABLE 5-continued

Validated pre-microRNA Sequences

| SEQ ID NO: | OLIGO ID. | Tissue of Validation |
|---|---|---|
| | | Prostate primary cell line normal (Cline 7) |
| | | T cells control |
| | | T cells treated with synthetic androgen "R1881" |
| | | Th1 |
| | | Total prostate RNA (Cline 1) |
| 183 | 3784-R1-2 | Th1eH |
| 184 | 3788-R2-2 | T cells treated with synthetic androgen "R1881" |
| 191 | 3817-R1-1 | Th1lH |
| | | Th2eM |
| | | Th2lH |
| 192 | 3819-L2-2 | T cells treated with synthetic androgen "R1881" |
| 200 | 3849-L1-2 | Th1lH |
| | | Th2lH |
| 205 | 3872-L1-1 | testes |
| 219 | 3920-L1-1 | Th1eH |
| | | Th1lH |
| | | Th2eH |
| | | Th2eM |
| | | Th2lH |
| 223 | | fat |
| | | kidney |
| | | T cells control |
| | | T cells treated with synthetic androgen "R1881" |
| | | testes |
| | | Th1lH |
| 224 | 3931-L1-1 | Th2eH |
| 248 | 3995-L2-1 | T cells control |
| | 3995-L2-2 | T cells treated with synthetic androgen "R1881" |
| | | Total prostate RNA (Cline 1) |
| | | Commercial prostate cell line androgen independent (Cline 2 and 3) |
| | | Total prostate RNA (Cline 1) |
| 275 | 4088-L1-2 | Th1lM |
| | | Th2lM |
| 276 | 9977-R2-1 | T cells control |
| | 4097-R2-1 | T cells treated with synthetic androgen "R1881" |
| 323 | 4284-L1-1 | Th1lH |
| | 4284-L1-2 | Th2lH |
| | | Th2eH |
| 328 | 4303-R1-1 | bone_marrow |
| | 4303-R1-2 | brain |
| | | colon |
| | | Commercial prostate cell line androgen dependent (Cline 4) |
| | | Commercial prostate cell line androgen independent (Cline 2 and 3) |
| | | Commercial prostate cell line immortalized (Cline 5) |
| | | fat |
| | | GFPp |
| | | GFP.RV |
| | | GFPs |
| | | kidney |
| | | liver |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | rat oestrogene stimulated |
| | | RVp |
| | | RVs |
| | | RV.Tbet |
| | | Sperm (PACH) |
| | | Sperm (SR) |
| | | spleen |
| | | T cells control |
| | | T cells treated with synthetic androgen "R1881" |
| | | testes |
| | | Th1 |
| | | Th1_early_human |
| | | Th1_early_mouse |
| | | Th1eH |
| | | Th1_late_mouse |
| | | Th2_early_human |
| | | Th2_early_mouse |
| | | Th2eH |
| | | Th2_late_mouse |

TABLE 5-continued

Validated pre-microRNA Sequences

| SEQ ID NO: | OLIGO ID. | Tissue of Validation |
|---|---|---|
| | | Thp |
| | | Thymocytes |
| | | thymus |
| | | Thymus |
| | | Total prostate RNA (Cline 1) |
| 344 | 4352-L1-1 | Th1eH |
| | | Th1lH |
| | | Th2eH |
| | | Th2eM |
| | | Th2lH |
| 357 | 4392-L1-2 | bone_marrow |
| 363 | 4417-R1-1 | bone_marrow |
| | | colon |
| | | Commercial prostate cell line androgen dependent (Cline 4) |
| | | Commercial prostate cell line androgen independent (Cline 2 and 3) |
| | | Commercial prostate cell line immortalized (Cline 5) |
| | | fat |
| | | GFP.RV |
| | | kidney |
| | | liver |
| | | muscle after insulin injection (CTRav) |
| | | muscle before insulin injection (CTRav) |
| | | Prostate primary cell line cancer (Cline 8) |
| | | Prostate primary cell line normal + cancer (Cline 6) |
| | | Prostate primary cell line normal (Cline 7) |
| | | RV.Tbet |
| | | Sperm (SR) |
| | | spleen |
| | | T cells control |
| | | testes |
| | | Th1 |
| | | Th1_early_human |
| | | Th1_early_mouse |
| | | Th1_late_mouse |
| | | Th2_early_human |
| | | Th2_early_mouse |
| | | Th2_late_mouse |
| | | Thp |
| | | thymus |
| | | Thymus |
| | | Total prostate RNA (Cline 1) |
| 366 | 4432-L1-1 | Th1eH |
| | 4432-L1-2 | Th2eH |
| | 4432-R1-1 | |
| 385 | 4482-R1-1 | Th1eH |
| 400 | 4528-R1-1 | Th1lH |
| | | Th2lH |
| 406 | 4567-L1-1 | Commercial prostate cell line androgen independent (Cline 2 and 3) |
| | | Commercial prostate cell line immortalized (Cline 5) |
| | | Prostate primary cell line normal (Cline 7) |
| | | testes |
| | | Th1eH |
| | | Th2eH |
| | | Total prostate RNA (Cline 1) |
| 407 | 5232-L2-1 | Commercial prostate cell line androgen independent (Cline 2 and 3) |
| | | Total prostate RNA (Cline 1) |
| 425 | 4638-L1-1 | Th2eM |
| 472 | 4829-R2-1 | Commercial prostate cell line androgen dependent (Cline 4) |
| | 4829-R2-2 | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| | | T cells treated with synthetic androgen "R1881" |
| 481 | 4875-R2-2 | Total prostate RNA (Cline 1) |
| 489 | 4892-L1-1 | Th1lH |
| | 4892-R1-1 | Th2lH |
| | 4892-R1-2 | |

TABLE 5-continued

Validated pre-microRNA Sequences

| SEQ ID NO: | OLIGO ID. | Tissue of Validation |
|---|---|---|
| 500 | 4939-L1-2 | Th1lH |
|  | 4939-R1-2 | Th2lH |
|  |  | fat |
|  |  | testes |
| 501 | 4946-L1-1 | Th2eH |
|  | 4946-R1-1 | Th1lH |
|  |  | Th2eM |
|  |  | Th2lH |
| 503 | 4958-R2-2 | T cells control |
|  |  | T cells treated with synthetic androgen "R1881" |
| 512 | 4983-L1-1 | Th1lH |
|  |  | Th2eM |
|  |  | Th2lH |
| 527 | 5063-L2-2 | T cells treated with synthetic androgen "R1881" |
| 530 | 5070-L1-1 | Th1lH |
|  |  | Th2eM |
|  |  | Th2lH |
| 531 | 5071-R2-1 | Commercial prostate cell line androgen independent (Cline 2 and 3) |
|  |  | T cells control |
|  |  | T cells treated with synthetic androgen "R1881" |
|  |  | Total prostate RNA (Cline 1) |
| 563 | 5193-R1-1 | testes |
| 608 | 5380-R2-2 | Commercial prostate cell line androgen dependent (Cline 4) |
|  |  | Commercial prostate cell line androgen independent (Cline 2 and 3) |
|  |  | Commercial prostate cell line immortalized (Cline 5) |
|  |  | Prostate primary cell line cancer (Cline 8) |
|  |  | Prostate primary cell line normal (Cline 7) |
|  |  | Total prostate RNA (Cline 1) |
| 633 | 5478-L2-2 | T cells treated with synthetic androgen "R1881" |
| 640 | 5497-R1-1 | Th1eH |
|  |  | Th2eH |
| 651 | 5534-L1-1 | Th2eM |
| 653 | 5554-L2-1 | T cells control |
|  | 5554-R2-1 | T cells treated with synthetic androgen "R1881" |
|  |  | Total prostate RNA (Cline 1) |
|  |  | Commercial prostate cell line androgen dependent (Cline 4) |
|  |  | Commercial prostate cell line androgen independent (Cline 2 and 3) |
|  |  | Commercial prostate cell line immortalized (Cline 5) |
|  |  | Prostate primary cell line cancer (Cline 8) |
|  |  | Prostate primary cell line normal (Cline 7) |
|  |  | Th1 |
| 664 | 5598-R2-2 | T cells control |
|  |  | T cells treated with synthetic androgen "R1881" |
| 678 | 5638-L1-1 | Th1eH |
|  | 5638-R2-1 | Th2eH |
|  |  | Commercial prostate cell line androgen independent (Cline 2 and 3) |
|  |  | muscle after insulin injection (CTRav) |
|  |  | Total prostate RNA (Cline 1) |
| 728 | 5795-R1-1 | bone_marrow |
|  |  | brain |
|  |  | Commercial prostate cell line androgen dependent (Cline 4) |
|  |  | Commercial prostate cell line androgen independent (Cline 2 and 3) |
|  |  | Commercial prostate cell line immortalized (Cline 5) |
|  |  | fat |
|  |  | GFP.RV |
|  |  | GFPs |
|  |  | kidney |
|  |  | liver |
|  |  | muscle after insulin injection (CTRav) |
|  |  | muscle after insulin injection to diabetic subject (DIABav) |
|  |  | muscle before insulin injection (CTRav) |
|  |  | muscle before insulin injection to diabetic subject (DIABav) |
|  |  | Prostate primary cell line cancer (Cline 8) |
|  |  | Prostate primary cell line normal + cancer (Cline 6) |
|  |  | Prostate primary cell line normal (Cline 7) |
|  |  | rat oestrogene stimulated |
|  |  | RVp |
|  |  | RVs |
|  |  | RV.Tbet |
|  |  | Sperm (PACH) |
|  |  | Sperm (SR) |
|  |  | spleen |
|  |  | T cells control |
|  |  | testes |
|  |  | Th1_early_human |
|  |  | Th1_early_mouse |

TABLE 5-continued

Validated pre-microRNA Sequences

| SEQ ID NO: | OLIGO ID. | Tissue of Validation |
|---|---|---|
| | | Th1eH |
| | | Th1_late_mouse |
| | | Th2_early_human |
| | | Th2_early_mouse |
| | | Th2eH |
| | | Th2_late_mouse |
| | | Thymocytes |
| | | thymus |
| | | Thymus |
| | | Total prostate RNA (Cline 1) |
| 744 | 5872-L1-1 | Th1eH |
| | 5872-L1-2 | Th2eH |
| | | Th2eM |
| | | Th1eM |
| 753 | 5903-R1-1 | Th1eH |
| | | Th2eH |
| 784 | 6008-R1-1 | Th1eH |
| | | Th2eH |
| 785 | 6016-R2-1 | Commercial prostate cell line androgen independent (Cline 2 and 3) |
| | 6016-R2-2 | Total prostate RNA (Cline 1) |
| 786 | 6023-R1-1 | Th1eH |
| | | Th1lH |
| | | Th2eH |
| | | Th2lH |
| 826 | 6190-R1-1 | Th1eH |
| | | Th2eH |
| 876 | 6404-R1-1 | Th1lH |
| | | Th2lH |
| 903 | 6478-L2-2 | Commercial prostate cell line androgen independent (Cline 2 and 3) |
| | 6478-R2-2 | Commercial prostate cell line immortalized (Cline 5) |
| | | Prostate primary cell line normal (Cline 7) |
| | | T cells control |
| | | T cells treated with synthetic androgen "R1881" |
| 909 | 6509-L1-1 | Th1eH |
| | 6509-L1-2 | Th1lH |
| | | Th2eH |
| | | Th2lH |
| | | Th2eM |
| 911 | 6521-L1-1 | Th1lH |
| | 6521-R1-1 | Th2lH |
| | 6521-R1-2 | fat |
| | | testes |
| | | Th1eH |
| 926 | 6584-L1-1 | Commercial prostate cell line androgen independent (Cline 2 and 3) |
| | | Sperm (SR) |
| | | Th2eH |
| | | Total prostate RNA (Cline 1) |
| 927 | 6587-R1-1 | Th1eH |
| | | Th2eH |
| 940 | 6647-R2-1 | T cells treated with synthetic androgen "R1881" |
| 942 | 6658-L1-1 | Th1lH |
| | | Th2lH |
| 944 | 6664-R2-1 | T cells control |
| | | T cells treated with synthetic androgen "R1881" |
| 946 | 6680-L1-1 | fat |
| | | kidney |
| | | testes |
| 947 | 6681-R1-1 | Commercial prostate cell line androgen dependent (Cline 4) |
| | 6681-R2-2 | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Total prostate RNA (Cline 1) |
| 951 | 6692-L1-1 | Th1eH |
| | | Th2eH |
| 955 | 6712-L2-1 | T cells treated with synthetic androgen "R1881" |
| 963 | 6752-R1-1 | bone_marrow |
| | | brain |
| | | colon |

TABLE 5-continued

Validated pre-microRNA Sequences

| SEQ ID NO: | OLIGO ID. | Tissue of Validation |
|---|---|---|
| | | Commercial prostate cell line androgen dependent (Cline 4) |
| | | Commercial prostate cell line androgen independent (Cline 2 and 3) |
| | | Commercial prostate cell line immortalized (Cline 5) |
| | | fat |
| | | GFPp |
| | | GFP.RV |
| | | GFPs |
| | | kidney |
| | | liver |
| | | lung |
| | | muscle |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | rat oestrogene stimulated |
| | | RVp |
| | | RVs |
| | | RV.Tbet |
| | | Sperm (PACH) |
| | | Sperm (SR) |
| | | spleen |
| | | T cells control |
| | | T cells treated with synthetic androgen "R1881" |
| | | testes |
| | | Th1 |
| | | Th1_early_human |
| | | Th1_early_mouse |
| | | Th1eH |
| | | Th1eM |
| | | Th1_late_mouse |
| | | Th1lM |
| | | Th2_early_human |
| | | Th2_early_mouse |
| | | Th2eH |
| | | Th2eM |
| | | Th2_late_mouse |
| | | Th2lM |
| | | Thp |
| | | Thymocytes |
| | | thymus |
| | | Thymus |
| | | Total prostate RNA (Cline 1) |
| 967 | 6762-L1-1 | Th1lH |
| | | Th2lH |
| 975 | 6797-R1-1 | T cells treated with synthetic androgen "R1881" |
| 1055 | 7089-R1-1 | Commercial prostate cell line androgen independent (Cline 2 and 3) |
| | | Commercial prostate cell line immortalized (Cline 5) |
| | | fat |
| | | testes |
| | | Th1_early_human |
| | | Th2_early_human |
| | | Total prostate RNA (Cline 1) |
| 1060 | 7104-R2-1 | T cells treated with synthetic androgen "R1881" |
| 1118 | 7356-L2-1 | Total prostate RNA (Cline 1) |
| 1129 | 7385-L1-1 | Th2eM |
| | 7385-L1-2 | Th1eH |
| | | Th2eH |
| 1137 | 7421-R2-1 | Commercial prostate cell line androgen independent (Cline 2 and 3) |
| 1145 | 7440-R1-2 | Th1eH |
| | | Th2eH |
| 1160 | 7522-L1-1 | Th1eH |
| | | Th2eH |
| 1161 | 7527-R2-2 | T cells treated with synthetic androgen "R1881" |
| 1166 | 7548-L1-1 | Th1lH |
| | | Th2lH |
| 1173 | 7571-L1-1 | bone_marrow |
| | 7571-R1-1 | Commercial prostate cell line androgen dependent (Cline 4) |
| | | Commercial prostate cell line androgen independent (Cline 2 and 3) |
| | | Commercial prostate cell line immortalized (Cline 5) |
| | | fat |
| | | GFPp |
| | | GFP.RV |

TABLE 5-continued

Validated pre-microRNA Sequences

| SEQ ID NO: | OLIGO ID. | Tissue of Validation |
|---|---|---|
| | | Prostate primary cell line cancer (Cline 8) |
| | | Prostate primary cell line normal (Cline 7) |
| | | RVs |
| | | RV.Tbet |
| | | Sperm (PACH) |
| | | Sperm (SR) |
| | | spleen |
| | | T cells control |
| | | testes |
| | | Th1 |
| | | Th1_late_mouse |
| | | Th2_late_mouse |
| | | Thymus |
| | | Total prostate RNA (Cline 1) |
| 1174 | 7572-R2-1 | Commercial prostate cell line androgen dependent (Cline 4) |
| | | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 1175 | 7573-R1-1 | testes |
| 1196 | 7660-L2-1 | Total prostate RNA (Cline 1) |
| 1198 | 7702-L2-1 | Commercial prostate cell line androgen independent (Cline 2 and 3) |
| | 7702-L2-2 | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal (Cline 7) |
| | | T cells control |
| | | T cells treated with synthetic androgen "R1881" |
| | | Th1 |
| | | Total prostate RNA (Cline 1) |
| 1205 | | kidney |
| | | testes |
| | | Th1eH |
| | | Th2eH |
| 1207 | 7755-R1-1 | Th1lH |
| | | Th2lH |
| 1217 | 7781-R1-1 | Th1eH |
| | | Th2eH |
| 1233 | 7828-L1-1 | Th1lH |
| | 7828-R1-1 | Th2lH |
| 1238 | 7849-R2-1 | T cells treated with synthetic androgen "R1881" |
| 1251 | 7905-L2-1 | T cells treated with synthetic androgen "R1881" |
| 1267 | 7983-L1-1 | Th1lH |
| 1299 | 8107-R1-1 | Th1lH |
| | | Th2lH |
| 1321 | 8222-R1-2 | Th1lH |
| 1323 | 8231-L1-1 | Th1lH |
| | | Th2eM |
| | | Th2lH |
| 1343 | 8302-L1-1 | Th2lH |
| 1352 | 8355-R1-1 | testes |
| 1396 | 8559-R2-1 | T cells treated with synthetic androgen "R1881" |
| 1403 | 8600-L1-1 | Th1eH |
| | 8600-R1-1 | Th2eH |
| 1485 | 9068-R2-1 | Commercial prostate cell line androgen dependent (Cline 4) |
| | | Commercial prostate cell line androgen independent (Cline 2 and 3) |
| | | Commercial prostate cell line immortalized (Cline 5) |
| | | Prostate primary cell line cancer (Cline 8) |
| | | Prostate primary cell line normal (Cline 7) |
| | | T cells control |
| | | T cells treated with synthetic androgen "R1881" |
| | | Total prostate RNA (Cline 1) |
| 1531 | 9245-R2-1 | Total prostate RNA (Cline 1) |
| 1545 | 9334-L2-2 | T cells treated with synthetic androgen "R1881" |

TABLE 5-continued

Validated pre-microRNA Sequences

| SEQ ID NO: | OLIGO ID. | Tissue of Validation |
|---|---|---|
| 1547 | 9347-R2-1 | T cells control |
|  |  | T cells treated with synthetic androgen "R1881" |
| 1559 | 9387-R2-2 | Commercial prostate cell line androgen independent (Cline 2 and 3) |
|  |  | Total prostate RNA (Cline 1) |
| 1586 | 9541-L1-1 | Th1eH |
| 1592 | 9564-R1-1 | Th1eH |
|  |  | Total prostate RNA (Cline 1) |
| 1601 | 9594-R2-1 | Total prostate RNA (Cline 1) |
| 1610 | 9625-R1-2 | Th2eM |
| 1611 | 9627-L1-1 | testes |
| 1617 | 9644-L1-1 | Th1eH |
|  | 9644-R2-2 | T cells treated with synthetic androgen "R1881" |
| 1634 | 9700-R1-1 | Th1eH |
|  |  | Th2eH |
|  |  | Th2eM |
| 1645 | 9736-R1-1 | Th1eH |
|  |  | Th2eH |
| 1649 | 9753-R1-1 | Th1eH |
|  | 9753-R1-2 | Th2eH |
| 1653 | 9767-L1-1 | Th1eH |
|  | 9767-R1-1 | Th2eH |
| 1656 | 9774-R2-1 | Commercial prostate cell line androgen dependent (Cline 4) |
|  | 9774-R2-2 | Commercial prostate cell line androgen independent (Cline 2 and 3) |
|  |  | Commercial prostate cell line immortalized (Cline 5) |
|  |  | muscle after insulin injection (CTRav) |
|  |  | muscle before insulin injection (CTRav) |
|  |  | Prostate primary cell line cancer (Cline 8) |
|  |  | Prostate primary cell line normal + cancer (Cline 6) |
|  |  | Prostate primary cell line normal (Cline 7) |
|  |  | T cells control |
|  |  | T cells treated with synthetic androgen "R1881" |
|  |  | Th1 |
|  |  | Total prostate RNA (Cline 1) |
| 1661 | 9794-L1-1 | Th1eH |
|  | 9794-L1-2 | Th2eH |
|  | 9794-R1-1 |  |
| 1667 | 9816-R2-1 | Commercial prostate cell line androgen dependent (Cline 4) |
|  |  | T cells control |
|  |  | T cells treated with synthetic androgen "R1881" |
|  |  | Total prostate RNA (Cline 1) |
| 1681 | 9905-L1-1 | Th1eH |
|  |  | Th2eH |
| 1686 | 9936-R2-1 | T cells treated with synthetic androgen "R1881" |
| 1688 | 9955-L1-1 | Th1eH |
|  | 9955-R1-1 | Th1lH |
|  |  | Th2eH |
|  |  | Th2lH |
| 1693 | 9987-R2-2 | Commercial prostate cell line androgen dependent (Cline 4) |
|  |  | Commercial prostate cell line androgen independent (Cline 2 and 3) |
|  |  | Commercial prostate cell line immortalized (Cline 5) |
|  |  | muscle after insulin injection (CTRav) |
|  |  | muscle before insulin injection (CTRav) |
|  |  | Prostate primary cell line cancer (Cline 8) |
|  |  | Prostate primary cell line normal (Cline 7) |
|  |  | T cells control |
|  |  | T cells treated with synthetic androgen "R1881" |
|  |  | Total prostate RNA (Cline 1) |
| 4773 | 5283-L1-1 | Fat |
|  |  | Testes |
|  |  | T cells |

*Th(½)eH = Th(½) early human  
Th(½)eM = Th(½) early mouse  
Th(½)lH = Th(½) late human  
Th(½)lM = Th(½) late mouse

TABLE 6

Validated microRNA Sequences

| SEQ ID NO: | OLIGO ID. | Tissue of Validation |
|---|---|---|
| 1697 | 8587-R2-1 | Commercial prostate cell line androgen independent (Cline 2 and 3) |
|  | 8587-R2-2 | Commercial prostate cell line immortalized (Cline 5) |

TABLE 6-continued

Validated microRNA Sequences

| SEQ ID NO: | OLIGO ID. | Tissue of Validation |
|---|---|---|
| | 10010-R2-1 | muscle after insulin injection (CTRav) |
| | 10010-R2-2 | muscle before insulin injection (CTRav) |
| | | muscle after insulin injection to diabetic subject (DIABav) |
| | | muscle before insulin injection to diabetic subject (DIABav) |
| | | Prostate primary cell line cancer (Cline 8) |
| | | Prostate primary cell line normal (Cline 7) |
| | | T cells control |
| | | T cells treated with synthetic androgen "R1881" |
| | | Th1 |
| | | Total prostate RNA (Cline 1) |
| 1698 | 8587-R2-1 | Commercial prostate cell line androgen independent (Cline 2 and 3) |
| | 8587-R2-2 | Commercial prostate cell line immortalized (Cline 5) |
| | 10010-R2-1 | muscle after insulin injection (CTRav) |
| | 10010-R2-2 | muscle before insulin injection (CTRav) |
| | | muscle after insulin injection to diabetic subject (DIABav) |
| | | muscle before insulin injection to diabetic subject (DIABav) |
| | | Prostate primary cell line cancer (Cline 8) |
| | | Prostate primary cell line normal (Cline 7) |
| | | T cells control |
| | | T cells treated with synthetic androgen "R1881" |
| | | Th1 |
| | | Total prostate RNA (Cline 1) |
| 1700 | 10018-L1-1 | Th1eH |
| | | Th2eH |
| 1719 | 10058-R1-1 | Th1eH |
| 1720 | 10058-R1-1 | Th1eH |
| 1721 | 10058-R1-1 | Th1eH |
| 1730 | 10093-L2-1 | Commercial prostate cell line androgen dependent (Cline 4) |
| | 10093-R2-1 | Commercial prostate cell line androgen independent (Cline 2 and 3) |
| | 10093-R2-2 | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 1731 | 10093-L2-1 | Commercial prostate cell line androgen dependent (Cline 4) |
| | 10093-R2-1 | Commercial prostate cell line androgen independent (Cline 2 and 3) |
| | 10093-R2-2 | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 1732 | 10093-L2-1 | Commercial prostate cell line androgen dependent (Cline 4) |
| | 10093-R2-1 | Commercial prostate cell line androgen independent (Cline 2 and 3) |
| | 10093-R2-2 | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 1744 | 10138-L2-1 | Commercial prostate cell line androgen dependent (Cline 4) |
| | 10138-L2-2 | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |

TABLE 6-continued

Validated microRNA Sequences

| SEQ ID NO: | OLIGO ID. | Tissue of Validation |
|---|---|---|
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 1745 | 10138-L2-1 | Commercial prostate cell line androgen dependent (Cline 4) |
| | 10138-L2-2 | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 1746 | 10145-L2-1 | T cells control |
| | | T cells treated with synthetic androgen "R1881" |
| | | Total prostate RNA (Cline 1) |
| 1747 | 10149-R1-1 | bone_marrow |
| | | Th1eH |
| | | Th2eH |
| 1748 | 10149-R1-1 | bone_marrow |
| | | Th1eH |
| | | Th2eH |
| 1749 | 10154-R1-1 | fat |
| | | testes |
| 1750 | 10154-R1-1 | fat |
| | | testes |
| 1784 | 10233-L2-2 | T cells treated with synthetic androgen "R1881" |
| 1785 | 10233-L2-2 | T cells treated with synthetic androgen "R1881" |
| 1805 | 10273-L1-1 | Th1eH |
| | 10273-R1-2 | Th1lH |
| | | Th2eH |
| | | Th2lH |
| 1806 | 10273-L1-1 | Th1eH |
| | 10273-R1-2 | Th1lH |
| | | Th2eH |
| | | Th2lH |
| 1807 | 10273-L1-1 | Th1eH |
| | 10273-R1-2 | Th1lH |
| | | Th2eH |
| | | Th2lH |
| 1815 | 10303-L1-1 | Th2eM |
| 1816 | 10303-L1-1 | Th2eM |
| 1817 | 10303-L1-1 | Th2eM |
| 1818 | 10303-L1-1 | Th2eM |
| 1824 | 10324-L1-1 | Th1eH |
| | 10324-L1-2 | Th2eM |
| 1825 | 10324-L1-1 | Th1eH |
| | 10324-L1-2 | Th2eM |
| 1826 | 10324-L1-1 | Th1eH |
| | 10324-L1-2 | Th2eM |
| 1827 | 10324-L1-1 | Th1eH |
| | 10324-L1-2 | Th2eM |
| 1828 | 10325-R2-1 | T cells treated with synthetic androgen "R1881" |
| 1837 | 10342-R2-2 | Commercial prostate cell line androgen dependent (Cline 4) |
| | | Commercial prostate cell line androgen independent (Cline 2 and 3) |
| | | Commercial prostate cell line immortalized (Cline 5) |
| | | Prostate primary cell line cancer (Cline 8) |
| | | T cells control |
| | | T cells treated with synthetic androgen "R1881" |
| | | Total prostate RNA (Cline 1) |
| 1838 | 10342-R2-2 | Commercial prostate cell line androgen dependent (Cline 4) |
| | | Commercial prostate cell line androgen independent (Cline 2 and 3) |
| | | Commercial prostate cell line immortalized (Cline 5) |
| | | Prostate primary cell line cancer (Cline 8) |
| | | T cells control |
| | | T cells treated with synthetic androgen "R1881" |
| | | Total prostate RNA (Cline 1) |

TABLE 6-continued

Validated microRNA Sequences

| SEQ ID NO: | OLIGO ID. | Tissue of Validation |
|---|---|---|
| 1839 | 10342-R2-2 | Commercial prostate cell line androgen dependent (Cline 4) |
| | | Commercial prostate cell line androgen independent (Cline 2 and 3) |
| | | Commercial prostate cell line immortalized (Cline 5) |
| | | Prostate primary cell line cancer (Cline 8) |
| | | T cells control |
| | | T cells treated with synthetic androgen "R1881" |
| | | Total prostate RNA (Cline 1) |
| 1842 | 10347-L1-2 | Th1eH |
| | | Th2eH |
| 1843 | 10347-L1-2 | Th1eH |
| | | Th2eH |
| 1896 | 10553-L1-1 | Th1lH |
| | 10553-R1-1 | Th2lH |
| | | brain |
| | | Commercial prostate cell line androgen dependent (Cline 4) |
| | | Commercial prostate cell line androgen independent (Cline 2 and 3) |
| | | Commercial prostate cell line immortalized (Cline 5) |
| | | GFP.RV |
| | | kidney |
| | | muscle after insulin injection (CTRav) |
| | | muscle before insulin injection (CTRav) |
| | | Prostate primary cell line cancer (Cline 8) |
| | | Prostate primary cell line normal (Cline 7) |
| | | RVp |
| | | RV.Tbet |
| | | spleen |
| | | T cells control |
| | | T cells treated with synthetic androgen "R1881" |
| | | testes |
| | | Thymocytes |
| | | thymus |
| | | Total prostate RNA (Cline 1) |
| 1897 | 10553-L1-1 | Th1lH |
| | 10553-R1-1 | Th2lH |
| | | brain |
| | | Commercial prostate cell line androgen dependent (Cline 4) |
| | | Commercial prostate cell line androgen independent (Cline 2 and 3) |
| | | Commercial prostate cell line immortalized (Cline 5) |
| | | GFP.RV |
| | | kidney |
| | | muscle after insulin injection (CTRav) |
| | | muscle before insulin injection (CTRav) |
| | | Prostate primary cell line cancer (Cline 8) |
| | | Prostate primary cell line normal (Cline 7) |
| | | RVp |
| | | RV.Tbet |
| | | spleen |
| | | T cells control |
| | | T cells treated with synthetic androgen "R1881" |
| | | testes |
| | | Thymocytes |
| | | thymus |
| | | Total prostate RNA (Cline 1) |
| 1898 | 10562-L1-1 | Th1lH |
| | 10562-L1-2 | Th2eM |
| | | Th2lH |
| | | Th2lH |
| 1899 | 10562-L1-1 | Th1lH |
| | 10562-L1-2 | Th2eM |
| | | Th2lH |
| | | Th2lH |
| 1900 | 10562-L1-1 | Th1lH |
| | 10562-L1-2 | Th2eM |
| | | Th2lH |
| | | Th2lH |
| 1911 | 10615-L1-1 | Th2lH |
| | 10615-L1-2 | Th1lH |
| | 10615-R1-1 | Th2eM |
| 1912 | 10615-L1-1 | Th2lH |
| | 10615-L1-2 | Th1lH |
| | 10615-R1-1 | Th2eM |
| 1913 | 10615-L1-1 | Th2lH |
| | 10615-L1-2 | Th1lH |
| | 10615-R1-1 | Th2eM |
| 1914 | 10617-R1-1 | Th1lH |
| | | Th2lH |

TABLE 6-continued

Validated microRNA Sequences

| SEQ ID NO: | OLIGO ID. | Tissue of Validation |
|---|---|---|
| 1915 | 10617-R1-1 | Th1lH |
| | | Th2lH |
| 1916 | 10617-R1-1 | Th1lH |
| | | Th2lH |
| 1917 | 10617-R1-1 | Th1lH |
| | | Th2lH |
| 1925 | 4155-L1-1 | Th1eM |
| 1926 | 4155-L1-1 | Th1eM |
| 1933 | 3717-L2-1 | Commercial prostate cell line androgen dependent (Cline 4) |
| | | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 1934 | 3717-L2-1 | Commercial prostate cell line androgen dependent (Cline 4) |
| | | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 1944 | 3740-R1-1 | Th2lH |
| 1945 | 3740-R1-1 | Th2lH |
| 1949 | 3755-L1-2 | Th1lH |
| | | Th2eH |
| | | Th2eM |
| | | Th2lH |
| 1950 | 3755-L1-2 | Th1lH |
| | | Th2eH |
| | | Th2eM |
| | | Th2lH |
| 1951 | 8231-L1-1 | Th1lH |
| | 3755-L1-2 | Th2eH |
| | | Th2eM |
| | | Th2lH |
| 1952 | 3758-R2-2 | Commercial prostate cell line androgen dependent (Cline 4) |
| | | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 1953 | 3758-R2-2 | Commercial prostate cell line androgen dependent (Cline 4) |
| | | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |

TABLE 6-continued

Validated microRNA Sequences

| SEQ ID NO: | OLIGO ID. | Tissue of Validation |
|---|---|---|
| | | T cells treated with synthetic androgen "R1881" |
| | | Th1 |
| | | Total prostate RNA (Cline 1) |
| 1954 | 3758-R2-2 | Commercial prostate cell line androgen dependent (Cline 4) |
| | | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 1959 | 3784-R1-2 | Th1eH |
| 1960 | 3784-R1-2 | Th1eH |
| 1961 | 3784-R1-2 | Th1eH |
| 1962 | 3784-R1-2 | Th1eH |
| 1963 | 8222-R1-2 | Th1lH |
| 1963 | 3788-R2-2 | T cells treated with synthetic androgen "R1881" |
| 1964 | 8222-R1-2 | Th1lH |
| 1964 | 3788-R2-2 | T cells treated with synthetic androgen "R1881" |
| 1975 | 3817-R1-1 | Th1lH |
| | | Th2eM |
| | | Th2lH |
| 1976 | 3817-R1-1 | Th1lH |
| | | Th2eM |
| | | Th2lH |
| 1977 | 3819-L2-2 | T cells treated with synthetic androgen "R1881" |
| 1978 | 3819-L2-2 | T cells treated with synthetic androgen "R1881" |
| 1979 | 3819-L2-2 | T cells treated with synthetic androgen "R1881" |
| 1990 | 3849-L1-2 | Th1lH |
| | | Th2lH |
| 1991 | 3849-L1-2 | Th1lH |
| | | Th2lH |
| 1992 | 3849-L1-2 | Th1lH |
| | | Th2lH |
| 1993 | 3849-L1-2 | Th1lH |
| | | Th2lH |
| 2000 | 3872-L1-1 | testes |
| 2001 | 3872-L1-1 | testes |
| 2002 | 3872-L1-1 | testes |
| 2025 | 3926-R1-2 | fat |
| | | kidney |
| | | T cells control |
| | | T cells treated with synthetic androgen "R1881" |
| | | testes |
| | | Th1lH |
| 2026 | | fat |
| | | kidney |
| | | T cells control |
| | | T cells treated with synthetic androgen "R1881" |
| | | testes |
| | | Th1lH |
| 2027 | 3931-L1-1 | Th2eH |
| 2028 | 3931-L1-1 | Th2eH |
| 2068 | 3995-L2-1 | T cells control |
| | 3995-L2-2 | T cells treated with synthetic androgen "R1881" |
| | | Total prostate RNA (Cline 1) |
| | | Commercial prostate cell line androgen independent (Cline 2 and 3) |
| | | Total prostate RNA (Cline 1) |
| 2108 | 4088-L1-2 | Th1lM |
| | | Th2lM |
| 2109 | 4088-L1-2 | Th1lM |
| | | Th2lM |
| 2110 | 4088-L1-2 | Th1lM |
| | | Th2lM |
| 2111 | 9977-R2-1 | T cells control |
| | | T cells treated with synthetic androgen "R1881" |
| 2111 | 4097-R2-1 | T cells treated with synthetic androgen "R1881" |
| 2112 | 9977-R2-1 | T cells control |
| | | T cells treated with synthetic androgen "R1881" |
| 2112 | 4097-R2-1 | T cells treated with synthetic androgen "R1881" |

TABLE 6-continued

Validated microRNA Sequences

| SEQ ID NO: | OLIGO ID. | Tissue of Validation |
|---|---|---|
| 2173 | 4284-L1-1 | Th1lH |
|  | 4284-L1-2 | Th2lH |
|  |  | Th2eH |
| 2174 | 4284-L1-1 | Th1lH |
|  | 4284-L1-2 | Th2lH |
|  |  | Th2eH |
| 2175 | 4284-L1-1 | Th1lH |
|  | 4284-L1-2 | Th2lH |
|  |  | Th2eH |
| 2180 | 4303-R1-1 | bone_marrow |
|  | 4303-R1-2 | brain |
|  |  | colon |
|  |  | Commercial prostate cell line androgen dependent (Cline 4) |
|  |  | Commercial prostate cell line androgen independent (Cline 2 and 3) |
|  |  | Commercial prostate cell line immortalized (Cline 5) |
|  |  | fat |
|  |  | GFPp |
|  |  | GFP.RV |
|  |  | GFPs |
|  |  | kidney |
|  |  | liver |
|  |  | muscle after insulin injection (CTRav) |
|  |  | muscle after insulin injection to diabetic subject (DIABav) |
|  |  | muscle before insulin injection (CTRav) |
|  |  | muscle before insulin injection to diabetic subject (DIABav) |
|  |  | Prostate primary cell line cancer (Cline 8) |
|  |  | Prostate primary cell line normal + cancer (Cline 6) |
|  |  | Prostate primary cell line normal (Cline 7) |
|  |  | rat oestrogene stimulated |
|  |  | RVp |
|  |  | RVs |
|  |  | RV.Tbet |
|  |  | Sperm (PACH) |
|  |  | Sperm (SR) |
|  |  | spleen |
|  |  | T cells control |
|  |  | T cells treated with synthetic androgen "R1881" |
|  |  | testes |
|  |  | Th1 |
|  |  | Th1_early_human |
|  |  | Th1_early_mouse |
|  |  | Th1eH |
|  |  | Th1_late_mouse |
|  |  | Th2_early_human |
|  |  | Th2_early_mouse |
|  |  | Th2eH |
|  |  | Th2_late_mouse |
|  |  | Thp |
|  |  | Thymocytes |
|  |  | thymus |
|  |  | Thymus |
|  |  | Total prostate RNA (Cline 1) |
|  |  | Commercial prostate cell line androgen independent (Cline 2 and 3) |
|  |  | Commercial prostate cell line immortalized (Cline 5) |
|  |  | Prostate primary cell line normal (Cline 7) |
|  |  | RV.Tbet |
|  |  | T cells treated with synthetic androgen "R1881" |
|  |  | thymus |
|  |  | Thymus |
|  |  | Total prostate RNA (Cline 1) |
| 2181 | 4303-R1-1 | bone_marrow |
|  | 4303-R1-2 | brain |
|  |  | colon |
|  |  | Commercial prostate cell line androgen dependent (Cline 4) |
|  |  | Commercial prostate cell line androgen independent (Cline 2 and 3) |
|  |  | Commercial prostate cell line immortalized (Cline 5) |
|  |  | fat |
|  |  | GFPp |
|  |  | GFP.RV |
|  |  | GFPs |
|  |  | kidney |
|  |  | liver |
|  |  | muscle after insulin injection (CTRav) |
|  |  | muscle after insulin injection to diabetic subject (DIABav) |
|  |  | muscle before insulin injection (CTRav) |
|  |  | muscle before insulin injection to diabetic subject (DIABav) |

TABLE 6-continued

Validated microRNA Sequences

| SEQ ID NO: | OLIGO ID. | Tissue of Validation |
|---|---|---|
| | | Prostate primary cell line cancer (Cline 8) |
| | | Prostate primary cell line normal + cancer (Cline 6) |
| | | Prostate primary cell line normal (Cline 7) |
| | | rat oestrogene stimulated |
| | | RVp |
| | | RVs |
| | | RV.Tbet |
| | | Sperm (PACH) |
| | | Sperm (SR) |
| | | spleen |
| | | T cells control |
| | | T cells treated with synthetic androgen "R1881" |
| | | testes |
| | | Th1 |
| | | Th1_early_human |
| | | Th1_early_mouse |
| | | Th1eH |
| | | Th1_late_mouse |
| | | Th2_early_human |
| | | Th2_early_mouse |
| | | Th2eH |
| | | Th2_late_mouse |
| | | Thp |
| | | Thymocytes |
| | | thymus |
| | | Thymus |
| | | Total prostate RNA (Cline 1) |
| | | Commercial prostate cell line androgen independent (Cline 2 and 3) |
| | | Commercial prostate cell line immortalized (Cline 5) |
| | | Prostate primary cell line normal (Cline 7) |
| | | RV.Tbet |
| | | T cells treated with synthetic androgen "R1881" |
| | | thymus |
| | | Thymus |
| | | Total prostate RNA (Cline 1) |
| 2201 | 4352-L1-1 | Th1eH |
| | | Th1lH |
| | | Th2eH |
| | | Th2eM |
| | | Th2lH |
| 2202 | 4352-L1-1 | Th1eH |
| | | Th1lH |
| | | Th2eH |
| | | Th2eM |
| | | Th2lH |
| 2203 | 4352-L1-1 | Th1eH |
| | | Th1lH |
| | | Th2eH |
| | | Th2eM |
| | | Th2lH |
| 2219 | 4392-L1-2 | bone_marrow |
| 2220 | 4392-L1-2 | bone_marrow |
| 2221 | 4392-L1-2 | bone_marrow |
| 2228 | 4417-R1-1 | bone_marrow |
| | | colon |
| | | Commercial prostate cell line androgen dependent (Cline 4) |
| | | Commercial prostate cell line androgen independent (Cline 2 and 3) |
| | | Commercial prostate cell line immortalized (Cline 5) |
| | | fat |
| | | GFP.RV |
| | | kidney |
| | | liver |
| | | muscle after insulin injection (CTRav) |
| | | muscle before insulin injection (CTRav) |
| | | Prostate primary cell line cancer (Cline 8) |
| | | Prostate primary cell line normal + cancer (Cline 6) |
| | | Prostate primary cell line normal (Cline 7) |
| | | RV.Tbet |
| | | Sperm (SR) |
| | | spleen |
| | | T cells control |
| | | testes |
| | | Th1 |
| | | Th1_early_human |
| | | Th1_early_mouse |
| | | Th1_late_mouse |

TABLE 6-continued

Validated microRNA Sequences

| SEQ ID NO: | OLIGO ID. | Tissue of Validation |
|---|---|---|
| | | Th2_early_human |
| | | Th2_early_mouse |
| | | Th2_late_mouse |
| | | Thp |
| | | thymus |
| | | Thymus |
| | | Total prostate RNA (Cline 1) |
| 2229 | 4417-R1-1 | bone_marrow |
| | | colon |
| | | Commercial prostate cell line androgen dependent (Cline 4) |
| | | Commercial prostate cell line androgen independent (Cline 2 and 3) |
| | | Commercial prostate cell line immortalized (Cline 5) |
| | | fat |
| | | GFP.RV |
| | | kidney |
| | | liver |
| | | muscle after insulin injection (CTRav) |
| | | muscle before insulin injection (CTRav) |
| | | Prostate primary cell line cancer (Cline 8) |
| | | Prostate primary cell line normal + cancer (Cline 6) |
| | | Prostate primary cell line normal (Cline 7) |
| | | RV.Tbet |
| | | Sperm (SR) |
| | | spleen |
| | | T cells control |
| | | testes |
| | | Th1 |
| | | Th1_early_human |
| | | Th1_early_mouse |
| | | Th1_late_mouse |
| | | Th2_early_human |
| | | Th2_early_mouse |
| | | Th2_late_mouse |
| | | Thp |
| | | thymus |
| | | Thymus |
| | | Total prostate RNA (Cline 1) |
| 2231 | 4432-L1-1 | Th1eH |
| | 4432-L1-2 | Th2eH |
| | 4432-R1-1 | |
| 2232 | 4432-L1-1 | Th1eH |
| | 4432-L1-2 | Th2eH |
| | 4432-R1-1 | |
| 2233 | 4432-L1-1 | Th1eH |
| | 4432-L1-2 | Th2eH |
| | 4432-R1-1 | |
| 2234 | 4432-L1-1 | Th1eH |
| | 4432-L1-2 | Th2eH |
| | 4432-R1-1 | |
| 2260 | 4482-R1-1 | Th1eH |
| 2278 | 4528-R1-1 | Th1lH |
| | | Th2lH |
| 2279 | 4528-R1-1 | Th1lH |
| | | Th2lH |
| 2280 | 4528-R1-1 | Th1lH |
| | | Th2lH |
| 2313 | 4638-L1-1 | Th2eM |
| 2314 | 4638-L1-1 | Th2eM |
| 2389 | 4829-R2-1 | Commercial prostate cell line androgen dependent (Cline 4) |
| | 4829-R2-2 | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| | | T cells treated with synthetic androgen "R1881" |
| 2390 | 4829-R2-1 | Commercial prostate cell line androgen dependent (Cline 4) |
| | 4829-R2-2 | Commercial prostate cell line androgen independent (Cline 2 and 3) |
| | | Commercial prostate cell line immortalized (Cline 5) |

TABLE 6-continued

Validated microRNA Sequences

| SEQ ID NO: | OLIGO ID. | Tissue of Validation |
|---|---|---|
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| | | T cells treated with synthetic androgen "R1881" |
| 2399 | 4875-R2-2 | Total prostate RNA (Cline 1) |
| 2408 | 4892-L1-1 | Th1lH |
| | 4892-R1-1 | Th2lH |
| | 4892-R1-2 | |
| 2409 | 4892-L1-1 | Th1lH |
| | 4892-R1-1 | Th2lH |
| | 4892-R1-2 | |
| 2410 | 4892-L1-1 | Th1lH |
| | 4892-R1-1 | Th2lH |
| | 4892-R1-2 | |
| 2427 | 4939-L1-2 | Th1lH |
| | 4939-R1-2 | Th2lH |
| | | fat |
| | | testes |
| 2428 | 4939-L1-2 | Th1lH |
| | 4939-R1-2 | Th2lH |
| | | fat |
| | | testes |
| 2429 | 4939-L1-2 | Th1lH |
| | 4939-R1-2 | Th2lH |
| | | fat |
| | | testes |
| 2430 | 4939-L1-2 | Th1lH |
| | 4939-R1-2 | Th2lH |
| | | fat |
| | | testes |
| 2431 | 4946-L1-1 | Th2eH |
| | 4946-R1-1 | Th1lH |
| | | Th2eM |
| | | Th2lH |
| 2432 | 4946-L1-1 | Th2eH |
| | 4946-R1-1 | Th1lH |
| | | Th2eM |
| | | Th2lH |
| 2433 | 4946-L1-1 | Th2eH |
| | 4946-R1-1 | Th1lH |
| | | Th2eM |
| | | Th2lH |
| 2434 | 4946-L1-1 | Th2eH |
| | 4946-R1-1 | Th1lH |
| | | Th2eM |
| | | Th2lH |
| 2437 | 4958-R2-2 | T cells control |
| | | T cells treated with synthetic androgen "R1881" |
| 2438 | 4958-R2-2 | T cells control |
| | | T cells treated with synthetic androgen "R1881" |
| 2450 | 4983-L1-1 | Th1lH |
| | | Th2eM |
| | | Th2lH |
| 2451 | 4983-L1-1 | Th1lH |
| | | Th2eM |
| | | Th2lH |
| 2469 | 5063-L2-2 | T cells treated with synthetic androgen "R1881" |
| 2470 | 5063-L2-2 | T cells treated with synthetic androgen "R1881" |
| 2471 | 5063-L2-2 | T cells treated with synthetic androgen "R1881" |
| 2476 | 5070-L1-1 | Th1lH |
| | | Th2eM |
| | | Th2lH |
| 2477 | 5071-R2-1 | Commercial prostate cell line androgen independent (Cline 2 and 3) |
| | | T cells control |
| | | T cells treated with synthetic androgen "R1881" |
| | | Total prostate RNA (Cline 1) |
| 2523 | 5193-R1-1 | testes |

TABLE 6-continued

Validated microRNA Sequences

| SEQ ID NO: | OLIGO ID. | Tissue of Validation |
|---|---|---|
| 2532 | 5232-L2-1 | Commercial prostate cell line androgen independent (Cline 2 and 3)<br>Total prostate RNA (Cline 1) |
| 2584 | 5380-R2-2 | Commercial prostate cell line androgen dependent (Cline 4)<br>Commercial prostate cell line androgen independent (Cline 2 and 3)<br>Commercial prostate cell line immortalized (Cline 5)<br>Prostate primary cell line cancer (Cline 8)<br>Prostate primary cell line normal (Cline 7)<br>Total prostate RNA (Cline 1) |
| 2585 | 5380-R2-2 | Commercial prostate cell line androgen dependent (Cline 4)<br>Commercial prostate cell line androgen independent (Cline 2 and 3)<br>Commercial prostate cell line immortalized (Cline 5)<br>Prostate primary cell line cancer (Cline 8)<br>Prostate primary cell line normal (Cline 7)<br>Total prostate RNA (Cline 1) |
| 2586 | 5380-R2-2 | Commercial prostate cell line androgen dependent (Cline 4)<br>Commercial prostate cell line androgen independent (Cline 2 and 3)<br>Commercial prostate cell line immortalized (Cline 5)<br>Prostate primary cell line cancer (Cline 8)<br>Prostate primary cell line normal (Cline 7)<br>Total prostate RNA (Cline 1) |
| 2587 | 5380-R2-2 | Commercial prostate cell line androgen dependent (Cline 4)<br>Commercial prostate cell line androgen independent (Cline 2 and 3)<br>Commercial prostate cell line immortalized (Cline 5)<br>Prostate primary cell line cancer (Cline 8)<br>Prostate primary cell line normal (Cline 7)<br>Total prostate RNA (Cline 1) |
| 2613 | 5478-L2-2 | T cells treated with synthetic androgen "R1881" |
| 2620 | 5497-R1-1 | Th1eH<br>Th2eH |
| 2621 | 5497-R1-1 | Th1eH<br>Th2eH |
| 2622 | 5497-R1-1 | Th1eH<br>Th2eH |
| 2637 | 5534-L1-1 | Th2eM |
| 2648 | 5598-R2-2 | T cells control<br>T cells treated with synthetic androgen "R1881" |
| 2649 | 5598-R2-2 | T cells control<br>T cells treated with synthetic androgen "R1881" |
| 2730 | 5795-R1-1 | bone_marrow<br>brain<br>Commercial prostate cell line androgen dependent (Cline 4)<br>Commercial prostate cell line androgen independent (Cline 2 and 3)<br>Commercial prostate cell line immortalized (Cline 5)<br>fat<br>GFP.RV<br>GFPs<br>kidney<br>liver<br>muscle after insulin injection (CTRav)<br>muscle after insulin injection to diabetic subject (DIABav)<br>muscle before insulin injection (CTRav)<br>muscle before insulin injection to diabetic subject (DIABav)<br>Prostate primary cell line cancer (Cline 8)<br>Prostate primary cell line normal + cancer (Cline 6)<br>Prostate primary cell line normal (Cline 7)<br>rat oestrogene stimulated<br>RVp<br>RVs<br>RV.Tbet<br>Sperm (PACH)<br>Sperm (SR)<br>spleen<br>T cells control<br>testes<br>Th1_early_human<br>Th1_early_mouse<br>Th1eH<br>Th1_late_mouse<br>Th2_early_human<br>Th2_early_mouse<br>Th2eH<br>Th2_late_mouse<br>Thymocytes<br>thymus<br>Thymus<br>Total prostate RNA (Cline 1) |

TABLE 6-continued

Validated microRNA Sequences

| SEQ ID NO: | OLIGO ID. | Tissue of Validation |
|---|---|---|
| 2754 | 5872-L1-1 | Th1eH |
|  | 5872-L1-2 | Th2eH |
|  |  | Th2eM |
|  |  | Th1eM |
| 2755 | 5872-L1-1 | Th1eH |
|  | 5872-L1-2 | Th2eH |
|  |  | Th2eM |
|  |  | Th1eM |
| 2756 | 5872-L1-1 | Th1eH |
|  | 5872-L1-2 | Th2eH |
|  |  | Th2eM |
|  |  | Th1eM |
| 2771 | 5903-R1-1 | Th1eH |
|  |  | Th2eH |
| 2809 | 6008-R1-1 | Th1eH |
|  |  | Th2eH |
| 2810 | 6008-R1-1 | Th1eH |
|  |  | Th2eH |
| 2811 | 6016-R2-1 | Commercial prostate cell line androgen independent (Cline 2 and 3) |
|  | 6016-R2-2 | Total prostate RNA (Cline 1) |
| 2812 | 6016-R2-1 | Commercial prostate cell line androgen independent (Cline 2 and 3) |
|  | 6016-R2-2 | Total prostate RNA (Cline 1) |
| 2813 | 6016-R2-1 | Commercial prostate cell line androgen independent (Cline 2 and 3) |
|  | 6016-R2-2 | Total prostate RNA (Cline 1) |
| 2814 | 6023-R1-1 | Th1eH |
|  |  | Th1lH |
|  |  | Th2eH |
|  |  | Th2lH |
| 2815 | 6023-R1-1 | Th1eH |
|  |  | Th1lH |
|  |  | Th2eH |
|  |  | Th2lH |
| 2862 | 6190-R1-1 | Th1eH |
|  |  | Th2eH |
| 2863 | 6190-R1-1 | Th1eH |
|  |  | Th2eH |
| 2864 | 6190-R1-1 | Th1eH |
|  |  | Th2eH |
| 2928 | 6404-R1-1 | Th1lH |
|  |  | Th2lH |
| 2929 | 6404-R1-1 | Th1lH |
|  |  | Th2lH |
| 2958 | 6478-L2-2 | Commercial prostate cell line androgen independent (Cline 2 and 3) |
|  | 6478-R2-2 | Commercial prostate cell line immortalized (Cline 5) |
|  |  | Prostate primary cell line normal (Cline 7) |
|  |  | T cells control |
|  |  | T cells treated with synthetic androgen "R1881" |
| 2959 | 6478-L2-2 | Commercial prostate cell line androgen independent (Cline 2 and 3) |
|  | 6478-R2-2 | Commercial prostate cell line immortalized (Cline 5) |
|  |  | Prostate primary cell line normal (Cline 7) |
|  |  | T cells control |
|  |  | T cells treated with synthetic androgen "R1881" |
| 2960 | 6478-L2-2 | Commercial prostate cell line androgen independent (Cline 2 and 3) |
|  | 6478-R2-2 | Commercial prostate cell line immortalized (Cline 5) |
|  |  | Prostate primary cell line normal (Cline 7) |
|  |  | T cells control |
|  |  | T cells treated with synthetic androgen "R1881" |
| 2961 | 6478-L2-2 | Commercial prostate cell line androgen independent (Cline 2 and 3) |
|  | 6478-R2-2 | Commercial prostate cell line immortalized (Cline 5) |
|  |  | Prostate primary cell line normal (Cline 7) |
|  |  | T cells control |
|  |  | T cells treated with synthetic androgen "R1881" |
| 2966 | 6509-L1-1 | Th1eH |
|  | 6509-L1-2 | Th1lH |
|  |  | Th2eH |
|  |  | Th2lH |
|  |  | Th2eM |
| 2967 | 6509-L1-1 | Th1eH |
|  | 6509-L1-2 | Th1lH |
|  |  | Th2eH |
|  |  | Th2lH |
|  |  | Th2eM |
| 2968 | 6509-L1-1 | Th1eH |
|  | 6509-L1-2 | Th1lH |
|  |  | Th2eH |

TABLE 6-continued

Validated microRNA Sequences

| SEQ ID NO: | OLIGO ID. | Tissue of Validation |
|---|---|---|
| | | Th2lH |
| | | Th2eM |
| 2971 | 6521-L1-1 | Th1lH |
| | 6521-R1-1 | Th2lH |
| | 6521-R1-2 | fat |
| | | testes |
| | | Th1eH |
| 2972 | 6521-L1-1 | Th1lH |
| | 6521-R1-1 | Th2lH |
| | 6521-R1-2 | fat |
| | | testes |
| | | Th1eH |
| 2973 | 6521-L1-1 | Th1lH |
| | 6521-R1-1 | Th2lH |
| | 6521-R1-2 | fat |
| | | testes |
| | | Th1eH |
| 2974 | 6521-L1-1 | Th1lH |
| | 6521-R1-1 | Th2lH |
| | 6521-R1-2 | fat |
| | | testes |
| | | Th1eH |
| 2999 | 6584-L1-1 | Commercial prostate cell line androgen independent (Cline 2 and 3) |
| | | Sperm (SR) |
| | | Th2eH |
| | | Total prostate RNA (Cline 1) |
| 3000 | 6587-R1-1 | Th1eH |
| | | Th2eH |
| 3001 | 6587-R1-1 | Th1eH |
| | | Th2eH |
| 3015 | 6647-R2-1 | T cells treated with synthetic androgen "R1881" |
| 3017 | 6658-L1-1 | Th1lH |
| | | Th2lH |
| 3018 | 6658-L1-1 | Th1lH |
| | | Th2lH |
| 3019 | 6658-L1-1 | Th1lH |
| | | Th2lH |
| 3021 | 6664-R2-1 | T cells control |
| | | T cells treated with synthetic androgen "R1881" |
| 3023 | 6680-L1-1 | fat |
| | | kidney |
| | | testes |
| 3024 | 6680-L1-1 | fat |
| | | kidney |
| | | testes |
| 3025 | 6681-R1-1 | Commercial prostate cell line androgen dependent (Cline 4) |
| | 6681-R2-2 | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Total prostate RNA (Cline 1) |
| 3026 | 6681-R1-1 | Commercial prostate cell line androgen dependent (Cline 4) |
| | 6681-R2-2 | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Total prostate RNA (Cline 1) |
| 3027 | 6681-R1-1 | Commercial prostate cell line androgen dependent (Cline 4) |
| | 6681-R2-2 | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |

TABLE 6-continued

Validated microRNA Sequences

| SEQ ID NO: | OLIGO ID. | Tissue of Validation |
|---|---|---|
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Total prostate RNA (Cline 1) |
| 3029 | 6692-L1-1 | Th1eH |
| | | Th2eH |
| 3030 | 6692-L1-1 | Th1eH |
| | | Th2eH |
| 3038 | 6712-L2-1 | T cells treated with synthetic androgen "R1881" |
| 3039 | 6712-L2-1 | T cells treated with synthetic androgen "R1881" |
| 3048 | 6752-R1-1 | bone_marrow |
| | | brain |
| | | colon |
| | | Commercial prostate cell line androgen dependent (Cline 4) |
| | | Commercial prostate cell line androgen independent (Cline 2 and 3) |
| | | Commercial prostate cell line immortalized (Cline 5) |
| | | fat |
| | | GFPp |
| | | GFP.RV |
| | | GFPs |
| | | kidney |
| | | liver |
| | | lung |
| | | muscle |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | rat oestrogene stimulated |
| | | RVp |
| | | RVs |
| | | RV.Tbet |
| | | Sperm (PACH) |
| | | Sperm (SR) |
| | | spleen |
| | | T cells control |
| | | T cells treated with synthetic androgen "R1881" |
| | | testes |
| | | Th1 |
| | | Th1_early_human |
| | | Th1_early_mouse |
| | | Th1eH |
| | | Th1eM |
| | | Th1_late_mouse |
| | | Th1lM |
| | | Th2_early_human |
| | | Th2_early_mouse |
| | | Th2eH |
| | | Th2eM |
| | | Th2_late_mouse |
| | | Th2lM |
| | | Thp |
| | | Thymocytes |
| | | thymus |
| | | Thymus |
| | | Total prostate RNA (Cline 1) |
| 3049 | 6752-R1-1 | bone_marrow |
| | | brain |
| | | colon |
| | | Commercial prostate cell line androgen dependent (Cline 4) |
| | | Commercial prostate cell line androgen independent (Cline 2 and 3) |
| | | Commercial prostate cell line immortalized (Cline 5) |
| | | fat |
| | | GFPp |
| | | GFP.RV |
| | | GFPs |
| | | kidney |
| | | liver |
| | | lung |

TABLE 6-continued

Validated microRNA Sequences

| SEQ ID NO: | OLIGO ID. | Tissue of Validation |
|---|---|---|
| | | muscle |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | rat oestrogene stimulated |
| | | RVp |
| | | RVs |
| | | RV.Tbet |
| | | Sperm (PACH) |
| | | Sperm (SR) |
| | | spleen |
| | | T cells control |
| | | T cells treated with synthetic androgen "R1881" |
| | | testes |
| | | Th1 |
| | | Th1_early_human |
| | | Th1_early_mouse |
| | | Th1eH |
| | | Th1eM |
| | | Th1_late_mouse |
| | | Th1lM |
| | | Th2_early_human |
| | | Th2_early_mouse |
| | | Th2eH |
| | | Th2eM |
| | | Th2_late_mouse |
| | | Th2lM |
| | | Thp |
| | | Thymocytes |
| | | thymus |
| | | Thymus |
| | | Total prostate RNA (Cline 1) |
| 3050 | 6752-R1-1 | bone_marrow |
| | | brain |
| | | colon |
| | | Commercial prostate cell line androgen dependent (Cline 4) |
| | | Commercial prostate cell line androgen independent (Cline 2 and 3) |
| | | Commercial prostate cell line immortalized (Cline 5) |
| | | fat |
| | | GFPp |
| | | GFP.RV |
| | | GFPs |
| | | kidney |
| | | liver |
| | | lung |
| | | muscle |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | rat oestrogene stimulated |
| | | RVp |
| | | RVs |
| | | RV.Tbet |
| | | Sperm (PACH) |
| | | Sperm (SR) |
| | | spleen |
| | | T cells control |
| | | T cells treated with synthetic androgen "R1881" |
| | | testes |
| | | Th1 |
| | | Th1_early_human |
| | | Th1_early_mouse |
| | | Th1eH |
| | | Th1eM |
| | | Th1_late_mouse |
| | | Th1lM |
| | | Th2_early_human |
| | | Th2_early_mouse |

TABLE 6-continued

Validated microRNA Sequences

| SEQ ID NO: | OLIGO ID. | Tissue of Validation |
|---|---|---|
| | | Th2eH |
| | | Th2eM |
| | | Th2_late_mouse |
| | | Th2lM |
| | | Thp |
| | | Thymocytes |
| | | thymus |
| | | Thymus |
| | | Total prostate RNA (Cline 1) |
| 3052 | 6762-L1-1 | Th1lH |
| | | Th2lH |
| 3053 | 6762-L1-1 | Th1lH |
| | | Th2lH |
| 3054 | 6762-L1-1 | Th1lH |
| | | Th2lH |
| 3061 | 6797-R1-1 | T cells treated with synthetic androgen "R1881" |
| 3062 | 6797-R1-1 | T cells treated with synthetic androgen "R1881" |
| 3162 | 7104-R2-1 | T cells treated with synthetic androgen "R1881" |
| 3232 | 7356-L2-1 | Total prostate RNA (Cline 1) |
| 3233 | 7356-L2-1 | Total prostate RNA (Cline 1) |
| 3249 | 7385-L1-1 | Th2eM |
| | 7385-L1-2 | Th1eH |
| | | Th2eH |
| 3250 | 7385-L1-1 | Th2eM |
| | 7385-L1-2 | Th1eH |
| | | Th2eH |
| 3261 | 7421-R2-1 | Commercial prostate cell line androgen independent (Cline 2 and 3) |
| 3271 | 7440-R1-2 | Th1eH |
| | | Th2eH |
| 3272 | 7440-R1-2 | Th1eH |
| | | Th2eH |
| 3273 | 7440-R1-2 | Th1eH |
| | | Th2eH |
| 3274 | 7440-R1-2 | Th1eH |
| | | Th2eH |
| 3300 | 7522-L1-1 | Th1eH |
| | | Th2eH |
| 3301 | 7522-L1-1 | Th1eH |
| | | Th2eH |
| 3302 | 7527-R2-2 | T cells treated with synthetic androgen "R1881" |
| 3303 | 7527-R2-2 | T cells treated with synthetic androgen "R1881" |
| 3304 | 7527-R2-2 | T cells treated with synthetic androgen "R1881" |
| 3320 | 7571-L1-1 | bone_marrow |
| | 7571-R1-1 | Commercial prostate cell line androgen dependent (Cline 4) |
| | | Commercial prostate cell line androgen independent (Cline 2 and 3) |
| | | Commercial prostate cell line immortalized (Cline 5) |
| | | fat |
| | | GFPp |
| | | GFP.RV |
| | | Prostate primary cell line cancer (Cline 8) |
| | | Prostate primary cell line normal (Cline 7) |
| | | RVs |
| | | RV.Tbet |
| | | Sperm (PACH) |
| | | Sperm (SR) |
| | | spleen |
| | | T cells control |
| | | testes |
| | | Th1 |
| | | Th1_late_mouse |
| | | Th2_late_mouse |
| | | Thymus |
| | | Total prostate RNA (Cline 1) |
| 3321 | 7571-L1-1 | bone_marrow |
| | 7571-R1-1 | Commercial prostate cell line androgen dependent (Cline 4) |
| | | Commercial prostate cell line androgen independent (Cline 2 and 3) |
| | | Commercial prostate cell line immortalized (Cline 5) |
| | | fat |
| | | GFPp |
| | | GFP.RV |
| | | Prostate primary cell line cancer (Cline 8) |
| | | Prostate primary cell line normal (Cline 7) |
| | | RVs |
| | | RV.Tbet |
| | | Sperm (PACH) |
| | | Sperm (SR) |

TABLE 6-continued

Validated microRNA Sequences

| SEQ ID NO: | OLIGO ID. | Tissue of Validation |
|---|---|---|
| | | spleen |
| | | T cells control |
| | | testes |
| | | Th1 |
| | | Th1_late_mouse |
| | | Th2_late_mouse |
| | | Thymus |
| | | Total prostate RNA (Cline 1) |
| 3322 | 7571-L1-1 | bone_marrow |
| | 7571-R1-1 | Commercial prostate cell line androgen dependent (Cline 4) |
| | | Commercial prostate cell line androgen independent (Cline 2 and 3) |
| | | Commercial prostate cell line immortalized (Cline 5) |
| | | fat |
| | | GFPp |
| | | GFP.RV |
| | | Prostate primary cell line cancer (Cline 8) |
| | | Prostate primary cell line normal (Cline 7) |
| | | RVs |
| | | RV.Tbet |
| | | Sperm (PACH) |
| | | Sperm (SR) |
| | | spleen |
| | | T cells control |
| | | testes |
| | | Th1 |
| | | Th1_late_mouse |
| | | Th2_late_mouse |
| | | Thymus |
| | | Total prostate RNA (Cline 1) |
| 3323 | 7572-R2-1 | Commercial prostate cell line androgen dependent (Cline 4) |
| | | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 3324 | 7572-R2-1 | Commercial prostate cell line androgen dependent (Cline 4) |
| | | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 3325 | 7572-R2-1 | Commercial prostate cell line androgen dependent (Cline 4) |
| | | Commercial prostate cell line androgen independent (Cline 2 and 3) |
| | | Commercial prostate cell line immortalized (Cline 5) |
| | | muscle after insulin injection (CTRav) |
| | | muscle after insulin injection to diabetic subject (DIABav) |
| | | muscle before insulin injection (CTRav) |
| | | muscle before insulin injection to diabetic subject (DIABav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 3326 | 7573-R1-1 | testes |
| 3327 | 7573-R1-1 | testes |
| 3328 | 7573-R1-1 | testes |
| 3329 | 7573-R1-1 | testes |
| 3358 | 7660-L2-1 | Total prostate RNA (Cline 1) |

TABLE 6-continued

Validated microRNA Sequences

| SEQ ID NO: | OLIGO ID. | Tissue of Validation |
|---|---|---|
| 3359 | 7660-L2-1 | Total prostate RNA (Cline 1) |
| 3360 | 7660-L2-1 | Total prostate RNA (Cline 1) |
| 3363 | 7702-L2-1 | Commercial prostate cell line androgen independent (Cline 2 and 3) |
|  | 7702-L2-2 | Commercial prostate cell line immortalized (Cline 5) |
|  |  | muscle after insulin injection (CTRav) |
|  |  | muscle after insulin injection to diabetic subject (DIABav) |
|  |  | muscle before insulin injection (CTRav) |
|  |  | muscle before insulin injection to diabetic subject (DIABav) |
|  |  | Prostate primary cell line cancer (Cline 8) |
|  |  | Prostate primary cell line normal (Cline 7) |
|  |  | T cells control |
|  |  | T cells treated with synthetic androgen "R1881" |
|  |  | Th1 |
|  |  | Total prostate RNA (Cline 1) |
| 3372 | 7747-R1-1 | kidney |
|  |  | testes |
|  |  | Th1eH |
|  |  | Th2eH |
| 3373 | 7747-R1-1 | kidney |
|  |  | testes |
|  |  | Th1eH |
|  |  | Th2eH |
| 3374 | 7747-R1-1 | kidney |
|  |  | testes |
|  |  | Th1eH |
|  |  | Th2eH |
| 3375 | 7747-R1-1 | kidney |
|  |  | testes |
|  |  | Th1eH |
|  |  | Th2eH |
| 3378 | 7755-R1-1 | Th1lH |
|  |  | Th2lH |
| 3379 | 7755-R1-1 | Th1lH |
|  |  | Th2lH |
| 3391 | 7781-R1-1 | Th1eH |
|  |  | Th2eH |
| 3392 | 7781-R1-1 | Th1eH |
|  |  | Th2eH |
| 3416 | 7828-L1-1 | Th1lH |
|  | 7828-R1-1 | Th2lH |
| 3417 | 7828-L1-1 | Th1lH |
|  | 7828-R1-1 | Th2lH |
| 3422 | 7849-R2-1 | T cells treated with synthetic androgen "R1881" |
| 3423 | 7849-R2-1 | T cells treated with synthetic androgen "R1881" |
| 3424 | 7849-R2-1 | T cells treated with synthetic androgen "R1881" |
| 3440 | 7905-L2-1 | T cells treated with synthetic androgen "R1881" |
| 3441 | 7905-L2-1 | T cells treated with synthetic androgen "R1881" |
| 3442 | 7905-L2-1 | T cells treated with synthetic androgen "R1881" |
| 3461 | 7983-L1-1 | Th1lH |
| 3497 | 8107-R1-1 | Th1lH |
|  |  | Th2lH |
| 3498 | 8107-R1-1 | Th1lH |
|  |  | Th2lH |
| 3499 | 8107-R1-1 | Th1lH |
|  |  | Th2lH |
| 3528 | 8231-L1-1 | Th1lH |
|  |  | Th2eM |
|  |  | Th2lH |
| 3555 | 8302-L1-1 | Th2lH |
| 3556 | 8302-L1-1 | Th2lH |
| 3557 | 8302-L1-1 | Th2lH |
| 3567 | 8355-R1-1 | testes |
| 3619 | 8559-R2-1 | T cells treated with synthetic androgen "R1881" |
| 3620 | 8559-R2-1 | T cells treated with synthetic androgen "R1881" |
| 3621 | 8559-R2-1 | T cells treated with synthetic androgen "R1881" |
| 3627 | 8600-L1-1 | Th1eH |
|  | 8600-R1-1 | Th2eH |
| 3628 | 8600-L1-1 | Th1eH |
|  | 8600-R1-1 | Th2eH |
| 3786 | 9245-R2-1 | Total prostate RNA (Cline 1) |
| 3804 | 9334-L2-2 | T cells treated with synthetic androgen "R1881" |
| 3805 | 9334-L2-2 | T cells treated with synthetic androgen "R1881" |
| 3806 | 9334-L2-2 | T cells treated with synthetic androgen "R1881" |
| 3807 | 9334-L2-2 | T cells treated with synthetic androgen "R1881" |
| 3808 | 9347-R2-1 | T cells control |
|  |  | T cells treated with synthetic androgen "R1881" |

TABLE 6-continued

Validated microRNA Sequences

| SEQ ID NO: | OLIGO ID. | Tissue of Validation |
|---|---|---|
| 3825 | 9387-R2-2 | Commercial prostate cell line androgen independent (Cline 2 and 3) |
| | | Total prostate RNA (Cline 1) |
| 3862 | 9541-L1-1 | Th1eH |
| 3863 | 9541-L1-1 | Th1eH |
| 3870 | 9564-R1-1 | Th1eH |
| | | Total prostate RNA (Cline 1) |
| 3871 | 9564-R1-1 | Th1eH |
| | | Total prostate RNA (Cline 1) |
| 3880 | 9594-R2-1 | Total prostate RNA (Cline 1) |
| 3881 | 9594-R2-1 | Total prostate RNA (Cline 1) |
| 3882 | 9594-R2-1 | Total prostate RNA (Cline 1) |
| 3896 | 9625-R1-2 | Th2eM |
| 3897 | 9625-R1-2 | Th2eM |
| 3898 | 9625-R1-2 | Th2eM |
| 3912 | 9644-L1-1 | Th1eH |
| | 9644-R2-2 | T cells treated with synthetic androgen "R1881" |
| 3931 | 9700-R1-1 | Th1eH |
| | | Th2eH |
| | | Th2eM |
| 3943 | 9736-R1-1 | Th1eH |
| | | Th2eH |
| 3950 | 9753-R1-1 | Th1eH |
| | 9753-R1-2 | Th2eH |
| 3951 | 9753-R1-1 | Th1eH |
| | 9753-R1-2 | Th2eH |
| 3956 | 9767-L1-1 | Th1eH |
| | 9767-R1-1 | Th2eH |
| 3957 | 9767-L1-1 | Th1eH |
| | 9767-R1-1 | Th2eH |
| 3959 | 9774-R2-1 | Commercial prostate cell line androgen dependent (Cline 4) |
| | 9774-R2-2 | Commercial prostate cell line androgen independent (Cline 2 and 3) |
| | | Commercial prostate cell line immortalized (Cline 5) |
| | | muscle after insulin injection (CTRav) |
| | | muscle before insulin injection (CTRav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 3960 | 9774-R2-1 | Commercial prostate cell line androgen dependent (Cline 4) |
| | 9774-R2-2 | Commercial prostate cell line androgen independent (Cline 2 and 3) |
| | | Commercial prostate cell line immortalized (Cline 5) |
| | | muscle after insulin injection (CTRav) |
| | | muscle before insulin injection (CTRav) |
| | | Prostate primary cell line cancer (Cline 8) |
| | | Prostate primary cell line normal + cancer (Cline 6) |
| | | Prostate primary cell line normal (Cline 7) |
| | | T cells control |
| | | T cells treated with synthetic androgen "R1881" |
| | | Th1 |
| | | Total prostate RNA (Cline 1) |
| 3966 | 9794-L1-1 | Th1eH |
| | 9794-L1-2 | Th2eH |
| | 9794-R1-1 | |
| 3967 | 9794-L1-1 | Th1eH |
| | 9794-L1-2 | Th2eH |
| | 9794-R1-1 | |
| 3968 | 9794-L1-1 | Th1eH |
| | 9794-L1-2 | Th2eH |
| | 9794-R1-1 | |
| 3973 | 9816-R2-1 | Commercial prostate cell line androgen dependent (Cline 4) |
| | | T cells control |
| | | T cells treated with synthetic androgen "R1881" |
| | | Total prostate RNA (Cline 1) |
| 3974 | 9816-R2-1 | Commercial prostate cell line androgen dependent (Cline 4) |
| | | T cells control |
| | | T cells treated with synthetic androgen "R1881" |
| | | Total prostate RNA (Cline 1) |
| 3975 | 9816-R2-1 | Commercial prostate cell line androgen dependent (Cline 4) |
| | | T cells control |
| | | T cells treated with synthetic androgen "R1881" |
| | | Total prostate RNA (Cline 1) |
| 3976 | 9816-R2-1 | Commercial prostate cell line androgen dependent (Cline 4) |
| | | T cells control |

TABLE 6-continued

Validated microRNA Sequences

| SEQ ID NO: | OLIGO ID. | Tissue of Validation |
|---|---|---|
| | | T cells treated with synthetic androgen "R1881" |
| | | Total prostate RNA (Cline 1) |
| 3986 | 9905-L1-1 | Th1eH |
| | | Th2eH |
| 3987 | 9905-L1-1 | Th1eH |
| | | Th2eH |
| 3991 | 9936-R2-1 | T cells treated with synthetic androgen "R1881" |
| 3992 | 9936-R2-1 | T cells treated with synthetic androgen "R1881" |
| 3993 | 9955-L1-1 | Th1eH |
| | 9955-R1-1 | Th1lH |
| | | Th2eH |
| | | Th2lH |
| 3994 | 9955-L1-1 | Th1eH |
| | 9955-R1-1 | Th1lH |
| | | Th2eH |
| | | Th2lH |
| 4001 | 9987-R2-2 | Commercial prostate cell line androgen dependent (Cline 4) |
| | | Commercial prostate cell line androgen independent (Cline 2 and 3) |
| | | Commercial prostate cell line immortalized (Cline 5) |
| | | muscle after insulin injection (CTRav) |
| | | muscle before insulin injection (CTRav) |
| | | Prostate primary cell line cancer (Cline 8) |
| | | Prostate primary cell line normal (Cline 7) |
| | | T cells control |
| | | T cells treated with synthetic androgen "R1881" |
| | | Total prostate RNA (Cline 1) |
| 4002 | 9987-R2-2 | Commercial prostate cell line androgen dependent (Cline 4) |
| | | Commercial prostate cell line androgen independent (Cline 2 and 3) |
| | | Commercial prostate cell line immortalized (Cline 5) |
| | | muscle after insulin injection (CTRav) |
| | | muscle before insulin injection (CTRav) |
| | | Prostate primary cell line cancer (Cline 8) |
| | | Prostate primary cell line normal (Cline 7) |
| | | T cells control |
| | | T cells treated with synthetic androgen "R1881" |
| | | Total prostate RNA (Cline 1) |
| 4003 | 9987-R2-2 | Commercial prostate cell line androgen dependent (Cline 4) |
| | | Commercial prostate cell line androgen independent (Cline 2 and 3) |
| | | Commercial prostate cell line immortalized (Cline 5) |
| | | muscle after insulin injection (CTRav) |
| | | muscle before insulin injection (CTRav) |
| | | Prostate primary cell line cancer (Cline 8) |
| | | Prostate primary cell line normal (Cline 7) |
| | | T cells control |
| | | T cells treated with synthetic androgen "R1881" |
| | | Total prostate RNA (Cline 1) |
| 4004 | 9627-L1-1 | testes |

REFERENCES

Bartel P., Cell, 116, 281-297, 2004.
Baskerville and al., RNA., Mar.; 11(3):241-7, 2005.
Bejerano G. and al., Bioinformatics, 4; 20 Suppl 1:140-148, 2004.
Bentwich and al., Nat. Genet., Jul.; 37(7):766-70 2005.
Berezikov and al., Cell., Jan. 14; 120(1):21-4, 2005.
Blume and al., Exp Cell Res., 288(1):131-42, 2003.
Brennecke and al., Cell., 113(1):25-36, 2003.
Brennecke and al., PLoS Biol., Mar.; 3(3):e85, 2005.
Burgler and al., BMC Genomics., Jun. 8; 6(1):88, 2005.
Calin and al., Proc Natl Acad Sci, USA, 26; 99(24):15524-9, 2002.
Calin et al., Proc Natl Acad Sci, USA, 10; 101(32):11755-60, 2004.
Calin and al., 2004.
Chen and al., Science, 303(5654):83-6, 2004.
Doench and al., Genes Dev., Mar. 1; 18(5):504-11, Epub, Mar. 10, 2004.
Dostie J, Mourelatos Z, Yang M, Sharma A, Dreyfuss G., "Numerous microRNPs in neuronal cells containing novel microARNs", RNA, 9(2):180-6, 2003. Erratum in: RNA, 9(5):631-2, 2003.
Enright and al., Genome Biol., 5(1):R1, 2003.
Esau and al., J Biol. Chem., 10; 279(50):52361-5, 2004.
Grun D and al., PLoS Comput Biol., Jun.; 1(1):e13, 2005.
He and al., Nat Rev Genet., 5(7):522-31, Review, 2004.
He L. and al., Nature, Jun. 9; 435(7043):828-33, 2005.
Houbaviy and al., Dev Cell. 5(2):351-8, 2003.
Ji and al., Oncogene, 11; 22(39):8031-41, 2003.
John and al., Biochem Biophys Res Commun., 17; 322(2): 403-10, 2004.
Kawasaki and al., Proc Natl Acad Sci, USA, 6; 101(1):360-5, 2004.
Kiriakidou and al., Genes Dev., May 15; 18(10):1165-78, 2004.
Krek and al., Nat Genet, May; 37(5):495-500, 2005.
Krichevsky and al., RNA, 9(10):1274-81, 2003.
Kuwabara, Cell., 19; 116(6):779-93, 2004.
Lai and al., Nat Genet., Apr.; 30(4):363-4, 2002.
Lai and al., Genome Biol., 4(7):R42, 2003.

Lewis and al., Cell., Dec. 26; 115(7):787-98, 2003.
Lewis and al., Cell., Jan. 14; 120(1):15-20, 2005.
Lim and al., Science, Mar. 7; 299(5612):1540, 2003.
Lim and al., Nature, 30, 2005.
Lu and al., Nature, Jun. 9; 435(7043):834-8 2005.
Mattick and al., Bioessays, 25(10):930-9, 2003.
Metzler and al., Genes Chromosomes Cancer, 39(2):167-9, 2004.
Michael and al., Mol Cancer Res., 1(12):882-91, 2003.
Miska and al., Genome Biol., 5(9):R68, 2004.
Muller-Tidow et al., Lung Cancer, 45 Suppl 2:S145-50, 2004.
Nam and al., Nucleic Acids Res., Jun. 24; 33(11):3570-81, 2005.
O'Donnell and al., Nature, Jun. 9; 435(7043):839-43, 2005.
Poy and al., Nature, 11; 432(7014):226-30, 2004.
Rehmsmeier and al., RNA, Oct.; 10(10):1507-17, 2004.
Reinhart and al., Nature, 403(6772):901-6, 2000.
Sempere and al., Genome Biol., 5(3):R13, 2004.
Stark and al., PLoS Biol., Dec.; 1(3):E60, 2003.
Takamizawa J. and al., Cancer Res., 1; 64(11):3753-6, 2004.
Tinzl and al., Trends Genet., 20(12):617-24, 2004, Review.

All publications and patent applications cited in this specification are herein incorporated by reference as if each individual publication or patent application were specifically and individually indicated to be incorporated by reference.

Although the foregoing invention has been described in some detail by way of illustration and example for purposes of clarity of understanding, it will be readily apparent to one of ordinary skill in the art in light of the teachings of this invention that certain changes and modifications may be made thereto without departing from the spirit or scope of the appended claims.

SEQUENCE LISTING (7835 sequences)

SEQ ID NO: 1 - DNA, 70 bp, Homo sapiens
gcttgtcttgagcagtgtttgggaaaaataggaattttcttgttactgtctattaagcctctcaagaagc

SEQ ID NO: 2 - DNA, 84 bp, Homo sapiens
gattacagctgatttgttatgtttaaacttccataatccatttacaaggtttgtccatttaaaatttataaattagcagttttc

SEQ ID NO: 3 - DNA, 89 bp, Homo sapiens
ccgggcgcccccgagagccggccctcccttcctccgtgacaggtgggcctggagttggggaaagtttggagccggcgaggggcgccggg

SEQ ID NO: 4 - DNA, 75 bp, Homo sapiens
gtattgttacctctttcagcatgtgggaaattaattgagtgattcatttcatagctattaaagtgttaacagtgc

SEQ ID NO: 5 - DNA, 80 bp, Homo sapiens
agctctgcacctcctccaggggatgaatctcatcttcagacaatgttaaactcattctcttgagcagaggtgaaaaagct

SEQ ID NO: 6 - DNA, 81 bp, Homo sapiens
gctaatattacaatctctacttggctccttgtctgctcttaattgcctagaagccaaaacagagactggtgagtgattagc

SEQ ID NO: 7 - DNA, 89 bp, Homo sapiens
cagtttattgaatttacagtaaaggttttatggggctttcctggaagcttcccattatggaaactcttgtgctggcagtttggtggctg

SEQ ID NO: 8 - DNA, 78 bp, Homo sapiens
ggatgcaaccgtggaagccggtgccgttgaggatctgccacaggcggaaggcagctgagttgacatccacgggcatcc

SEQ ID NO: 9 - DNA, 78 bp, Homo sapiens
ggtctgaaggatcatgaaacagtatgttgaaattggtaaagactgatcttgacatattcctctgacaaccttttgatt

SEQ ID NO: 10 - DNA, 81 bp, Homo sapiens
gggtaaaaaattgtaatttattgaaactcaactggaaaagtatcagatgcttcagtgtacaataaattgcacaaagcaccc

SEQ ID NO: 11 - DNA, 86 bp, Homo sapiens
tagtttaaaaaatgttattaaacataatggctccttgacatttaagtagcactgtgttttaggtgatcttcatttttgaagaacta

SEQ ID NO: 12 - DNA, 77 bp, Homo sapiens
gccgcaatcagggagaaaaggctgcttgggcgcttggcgcccacgcgtgcgcctaattggctccacgtgtctgcggc

SEQ ID NO: 13 - DNA, 89 bp, Homo sapiens
tgtgcattcaataggattatgaggctttgatcatacaaatgcaaaagagatttggcagtaacaggaagtaacatagttctagaagcaca

SEQ ID NO: 14 - DNA, 89 bp, Homo sapiens
cttttctattgatgtatcaactataatagttacaagcagctacagaaaaatcaatagcgagctttcattactgtgtacatcaagtaaag

SEQ ID NO: 15 - DNA, 73 bp, Homo sapiens
ttctattcttatcagagttttgcaagagggttgcaagcggcccatgttaattgaagctttgatgtttgtagga

SEQ ID NO: 16 - DNA, 87 bp, Homo sapiens
ggcatacacaaggatgacatagatttgacaaaaaattaatgatttgtacatcactttaatgcctcaaatctgcaattcatgtatgct

SEQ ID NO: 17 - DNA, 79 bp, Homo sapiens
tgctcacttgactgacaggtgcagcatgttgatggataaactcaacatgaaatgcaataggtcaaagaaggaatgagca

SEQ ID NO: 18 - DNA, 82 bp, Homo sapiens
tgtcagtcatcatcagtcagttaattaggcaactaatacctttaggggtcatgaatctaacaggactgaagttgacggggcg

SEQ ID NO: 19 - DNA, 71 bp, Homo sapiens
aaatggtttattagagtgttaacctccattagctgagaggctaggtcattagctgcctctgataaccattt

SEQ ID NO: 20 - DNA, 75 bp, Homo sapiens
tctgaatgttggtggcaatatagaaatgcattgaagtgtttctaacaaagctgccctccctgcctagcattcaga

SEQ ID NO: 21 - DNA, 73 bp, Homo sapiens
tgagcgaggagaaacatcagtttataattaggtggcctaatcacctgtgtaaattgtgtatttcttatgatcg

SEQ ID NO: 22 - DNA, 84 bp, Homo sapiens
tgtttccagcattcccaggtaggccaaggtgtcctacagaaaaaccttgggttagacctacagggggtctggctggtgttaaca

SEQ ID NO: 23 - DNA, 70 bp, Homo sapiens
ctatagttagaaaaacactgtggagctgttcagaaatggagatgatgttcacagtgtattttaaaggtgg

SEQ ID NO: 24 - DNA, 78 bp, Homo sapiens
aagtcttacaattcagggataggaagctatgatttacataatgaacatggcaaagagacctataaagaaataagactt

SEQ ID NO: 25 - DNA, 85 bp, Homo sapiens
tgagtttaattaaaagaaatctaccctttaataacttcaggggaaaatgcagttccttatggagtttgaaatttagttaagctca

SEQ ID NO: 26 - DNA, 80 bp, Homo sapiens
gacctttacagttgccatggcaatataatttccataaacatgatttttgtggggatttttgcacattgaaggctgaggtt

SEQ ID NO: 27 - DNA, 71 bp, Homo sapiens
ggtctcctgctctgctgatcagtgtctcatagggcaagtcctgagggatctgggacaacaggtggtggacc

SEQ ID NO: 28 - DNA, 77 bp, Homo sapiens
caagtttcctgagccctgggttgatatactgtaccatctttggtgcagctgtaattttaacaaggggaaccgacttg

SEQ ID NO: 29 - DNA, 74 bp, Homo sapiens
gtagctgctgaaatcttggcttgcacccaaatgccccacttgggttttgttcagaaaagatttcctccagctgc

SEQ ID NO: 30 - DNA, 82 bp, Homo sapiens
tgaatgaagagtcagcaaatgagcaggtttccatttgaaatttaaattggcagctggcactatttgaatcattcttcattta

SEQ ID NO: 31 - DNA, 76 bp, Homo sapiens
ctcttcccatatttaatgtggctctaattctgacttcattgcagagcggtgaaatcaaattaggaaatgggaggag

SEQ ID NO: 32 - DNA, 87 bp, Homo sapiens
actttttctggtgggaggggagagcggagcaggctcacgtgtaaccgcgcaggagcctcctctggcttgagccctttcttggtaagt

SEQ ID NO: 33 - DNA, 82 bp, Homo sapiens
aggtaatgcattctgcatggtagtttgggtctgagaaagttctaagaacttagtgacaattatgcattgtgcttcattattt

SEQ ID NO: 34 - DNA, 80 bp, Homo sapiens
ggtccagataacagaagagagagcaaaggaaaaagaattttttgaagatcaaaagtggctgttcattttgttatctgacc

SEQ ID NO: 35 - DNA, 86 bp, Homo sapiens
gatggtgggcatgggtcagaaggactcctacgtgggcgacaagggcccagagcaagagaggcattctgaccctgaagtaccgcatc

SEQ ID NO: 36 - DNA, 73 bp, Homo sapiens
attccaagggtctgacacttgtctaaatcctgtagaaatgagatcaagggcaaagggcacagatcctgggaat

SEQ ID NO: 37 - DNA, 88 bp, Homo sapiens
ttacctagggaatctggtttgaaaattggacattaagttacacttctaattgaaatgaatttgatggtttcagaacagtccccagtga

SEQ ID NO: 38 - DNA, 81 bp, Homo sapiens
gatgttgatgtctactagatggagcagaaataattaatgttgcttttcggcagcatgatttatcagggatgacacagcatt

SEQ ID NO: 39 - DNA, 71 bp, Homo sapiens
gccgcagtcgccagggcccctagtgtgaaggaatttgagttctaactttaggtggctacgtggctgatggc

SEQ ID NO: 40 - DNA, 71 bp, Homo sapiens
gctgtattgcttatgtaccactggggattggagtagtgagacttaaattgcttgtggaacaaagcaaaagc

SEQ ID NO: 41 - DNA, 74 bp, Homo sapiens
ttaactgtccccaagtacagagctagggaatggttgtaatgatacctaaattctgtgacttgggaaaaagttag

SEQ ID NO: 42 - DNA, 75 bp, Homo sapiens
gtggggatggagagacgactgggttggggcgggcaaaattgctcaggtcacagctgggaatctcattctcctcat

SEQ ID NO: 43 - DNA, 90 bp, Homo sapiens
cttagtggtttcccccactgctctgtctgtcacagcaagatttgcaaggctgagaaataatttaaagggtagtaaatgaaaccggctaag

SEQ ID NO: 44 - DNA, 68 bp, Homo sapiens
catctttgtggctcctggttgctaggagcaggtgcttctgttactaagcaacaggagcctgttggatg

SEQ ID NO: 45 - DNA, 72 bp, Homo sapiens
gcaatatgtgctatcatagcttcaattttcctgccaagtagagagtgacagctgtgtggcaatatctaatgc

SEQ ID NO: 46 - DNA, 74 bp, Homo sapiens
atcaagtcatacattctggagagtctttgtaaatagttttgcctacaactaaccatggtatgatatgacatgat

SEQ ID NO: 47 - DNA, 86 bp, Homo sapiens
gttttcttttcctgtgtcttggtttccacatttataagctagacttgtaccaagaagaaaccaatacataattggaaaaagaaaat

SEQ ID NO: 48 - DNA, 84 bp, Homo sapiens
gtgccaaactgttagactcatcaagtttatgaacactgcatacaaaatgcaaacattttcttccatttgggcaaacattggcac

SEQ ID NO: 49 - DNA, 80 bp, Homo sapiens
gggttgtgttgtcatggtaaccctatattcaaggttgaaaagctttattgaatgttttgggtatttctccatcgcagcct

SEQ ID NO: 50 - DNA, 89 bp, Homo sapiens
gtctatgaagttccagggactgggtgattctgtgtctgctattttaatggcctttaaacagtgtctgcccaggtaggcattttatagat

SEQ ID NO: 51 - DNA, 77 bp, Homo sapiens
gagcagttcttgttgcccatcacattttagtgcagggaagtgctttgccctaaaggtgccaggtaaagagaattgcc

SEQ ID NO: 52 - DNA, 82 bp, Homo sapiens
tcaatttgttacatagctaacttattttctaatagactatgttggtaataagaaaatgaattacatgctgttggcagagtga

SEQ ID NO: 53 - DNA, 84 bp, Homo sapiens
gcaggcccctttaacgtggcaagtctaagaaatgtcggccttcttggcagcgaatctgggcttggttccactgggggcgtctgc

SEQ ID NO: 54 - DNA, 75 bp, Homo sapiens
gaagggctgtactttatgcttttgcaatgtttacagaacctgtaacacaatggagcatgattaatgagactcttc

SEQ ID NO: 55 - DNA, 79 bp, Homo sapiens
gttgcctatttgaaagggaaacagccatatgaaccgttttgtggttccaggtgttgctgtcttcctaaatagtagcaac

SEQ ID NO: 56 - DNA, 83 bp, Homo sapiens
tattagttacaatatattaactgcctaatttaaaaataaaactatctttatgaagggcaattaaccactaagtgtaattgata

SEQ ID NO: 57 - DNA, 88 bp, Homo sapiens
gtgtaggcaagcagtagcttagaaaacacttaatctattttttaaaatctgttcctaagttttctttgcttaggctgtaagactacat

SEQ ID NO: 58 - DNA, 87 bp, Homo sapiens
ggcggctgcggaggctggcgcgggctgctgcacctttaacgctttctggcgctgacaggcggcggcccagctaaagttcacagcgcc

SEQ ID NO: 59 - DNA, 87 bp, Homo sapiens
ctgggactgattagccgtggtgcagctacatgcagtttttaattgattgatttgagtttgtggtcagaaaatggctgtcggctccag

SEQ ID NO: 60 - DNA, 85 bp, Homo sapiens
accttctgcctttgagacctggaagccacagcactggtggacataaattctactgcctgctgctccagatccaaggggagagggt

SEQ ID NO: 61 - DNA, 78 bp, Homo sapiens
ttctgtgttttctatttgctgctaaatgaaaacaaatatagttttttctttagatcttatagcaaactaaaaacagaa

SEQ ID NO: 62 - DNA, 82 bp, Homo sapiens
aatttgatgtagtctagacaacctatattgataatatcttttccagaatttcatagattgactgtctagactgcttcaaatt

SEQ ID NO: 63 - DNA, 79 bp, Homo sapiens
ggcaggaaggcctccggcttcacaaagtggccctgggcatccaggaagtgttcggggtggaagcggaagggcttcttcc

SEQ ID NO: 64 - DNA, 89 bp, Homo sapiens
gattatatgccagatgttcaaactatctctaatcattgcagatgtaatggagtagaatgttgcagtttgtgagtttactggcattaatc

SEQ ID NO: 65 - DNA, 86 bp, Homo sapiens
gtttaatatttatgctaagaggattgtcaaaagcagcttctgttgctttaattcttgttttaaataaataatgagaacatttaaac

SEQ ID NO: 66 - DNA, 78 bp, Homo sapiens
agccacagcagtatagcaaaagaggcttaatctttataaattggggccttttctgtctctttgctagcctaggtggct

SEQ ID NO: 67 - DNA, 76 bp, Homo sapiens
gtgggagacatcgggtgggggccctggcgaacaataggtgggcccagctggggccccctcctgcctgcctcaccgc

SEQ ID NO: 68 - DNA, 84 bp, Homo sapiens
catatgctgtatatggagaaacttctaaacattatgctctatgtaatatgcttatctgaaaaagctctcatttgcagcaatatg

SEQ ID NO: 69 - DNA, 89 bp, Homo sapiens
acccagagtcaattactcactgtgtgaatcacccccaaaagattgctttttccttttccattagtatcacacataattgcactctgtgt

SEQ ID NO: 70 - DNA, 88 bp, Homo sapiens
cagttagccagagtggtctggacacacagatttatcttccctcttcttcagtgaagaacatctatcttccatgacctcttgattactg

SEQ ID NO: 71 - DNA, 77 bp, Homo sapiens
ctctcccttgatttcattacttctacttcctctcctaactggattagatggcagtctatgaaatccagggcatagag

SEQ ID NO: 72 - DNA, 79 bp, Homo sapiens
aatgaatcaaattaactatataactgccaaaatgtaatcccattcaggcagtgaaatatctggttttattgtctacatt

SEQ ID NO: 73 - DNA, 89 bp, Homo sapiens
ggaggagagtatcttaattttattgtttttgctaatgctgttaacagctgtcctggcaatagcttttatgagaataaatgctttctgac

SEQ ID NO: 74 - DNA, 89 bp, Homo sapiens
tctagagattaaataattatttcattccagctttattaaataatacaaattcagctcattggtaatgaaaataatcataagtcactgga

SEQ ID NO: 75 - DNA, 84 bp, Homo sapiens
atttctaaagaaggctgttagattcagatggtaatctcagcccccttctggctcattccctggactcttggcctcattagaaat

SEQ ID NO: 76 - DNA, 80 bp, Homo sapiens
tcactctcaacaaattcttccagccgacagaaatggcttctcaggatttctttcaacgttggaagcagttgagcaagtga

SEQ ID NO: 77 - DNA, 83 bp, Homo sapiens
atggcagagatattgacatagtgagaaaacattgccttcaacaatagggctttgttgacaaaacagtgaaatgtctagaccat

SEQ ID NO: 78 - DNA, 82 bp, Homo sapiens
taattcctgcaataacaattttattctttccataattcttcagggcaatgctggaggaataatatttttactgcagtgattg

SEQ ID NO: 79 - DNA, 85 bp, Homo sapiens
aggtgagtgtccggaggtgctgggtaaaacacatcacaggtaagaaatgggaaacctacctcagcatttctgaaaggcacaatct

SEQ ID NO: 80 - DNA, 90 bp, Homo sapiens
acttcctaatatattatgtcctcccctgccgagtccggggacttagtctggatttggtaactgaagtaatataaatgttagctaagaagt

SEQ ID NO: 81 - DNA, 86 bp, Homo sapiens
gtgtattgtgagtgtcccttgccatatttctgctaatgtgtttcatctggagtacataaagaggcagggatgctgattttagacac

SEQ ID NO: 82 - DNA, 82 bp, Homo sapiens
tgaaaatcataagccctaagctttagagagagttgtgcaattgacaatcaaatggagcttaaagggaattaggaggttttca

SEQ ID NO: 83 - DNA, 85 bp, Homo sapiens
agagcaatcagtttcaggtttctggatgagcctgtggccaggccataattaaccttttgaacttggaattgtagcagaatgttct

SEQ ID NO: 84 - DNA, 78 bp, Homo sapiens
gacggctttggagattatggggaacatatggccctaccgccgggctctttatctgcattttctcataaaactgccgtc

SEQ ID NO: 85 - DNA, 72 bp, Homo sapiens
cggggcaggggagggggtgggcagggcacaagcctcccactgtgccgtgtccccaccctcccccgttccccg

SEQ ID NO: 86 - DNA, 75 bp, Homo sapiens
ttccacattattaatgaactttgcagcagttccacttgtcagagcctactctgtaggggtcaataatgagaggaa

SEQ ID NO: 87 - DNA, 85 bp, Homo sapiens
tcttagtgctttctaattaaaaaggaggggagtggtgatctttttgctctctaagttctgtttcctctgagtggaaagcagaggg

SEQ ID NO: 88 - DNA, 89 bp, Homo sapiens
ctgttcatttcgttcctcagtgaaaacgttagcctaagggacatttgaaaatcaaaaggtaggcttggagtttaacaggaaatgaacag

SEQ ID NO: 89 - DNA, 78 bp, Homo sapiens
ttgggccgaataataactactttgaagacaaatgaaatgtatttcacttgtacaaattaaagcatagttacagtccaa

SEQ ID NO: 90 - DNA, 72 bp, Homo sapiens
cccacgcacggagggtcgccaggaaagtggacattaccgctttaattaacttcgagatgctccggcggcggg

SEQ ID NO: 91 - DNA, 81 bp, Homo sapiens
accctcaagctctcaagtggtgaccaccgtccttccggccaggtaggactggatgggaggggtcgcttttgagagaagggt

SEQ ID NO: 92 - DNA, 81 bp, Homo sapiens
tgggcagagccaggtctgcaccctcgggagccctggaggccaggtgagctgctgcagagggcacagacaggctcatactca

SEQ ID NO: 93 - DNA, 82 bp, Homo sapiens
ggaagaaacggatcgcatggctcatttatcttgcagccattaattaatggtggttaattgtagttatgagctgttgaattcc

SEQ ID NO: 94 - DNA, 81 bp, Homo sapiens
ctctctcttgctgaactctgtgtccagggttctctagccctctagggaaacaaacacatggaatattcagacagtggagag

SEQ ID NO: 95 - DNA, 82 bp, Homo sapiens
cttgaggaagctgtaaggtctttggcacttggctaaaaatagcagaagtaaaacaggtgacaaagatgaatagctcccagag

SEQ ID NO: 96 - DNA, 77 bp, Homo sapiens
tcatttaacatatttctgtctctgaatggcttttacttttcactaaattgaaaccgcagtacaatatatgtgaatga

SEQ ID NO: 97 - DNA, 90 bp, Homo sapiens
gaataccattaatctgttcactaggagattaatttgcaatttgttggcaaatcacatgtgggtcttgtagcaagagcgtgggtggtgttt

SEQ ID NO: 98 - DNA, 81 bp, Homo sapiens
atgaaaattatgacaggaaacaacaattataagcaataaacatttgctattgaattgctttctaaccatattaattttcat

SEQ ID NO: 99 - DNA, 88 bp, Homo sapiens
caggggatttgttaccgctgatgtgtggcccgtccgaatgaagggggcttttcattaacaaagtagcgggcggtgtcatcttcccctg

SEQ ID NO: 100 - DNA, 76 bp, Homo sapiens
tgtgtgtctgggaaaatagtcacaggatacaatcctttattaaaggtcactatttttcaccagcacttaacacaca

SEQ ID NO: 101 - DNA, 84 bp, Homo sapiens
ggaatacagacagcaaatggccagatggccctgcagtaaactgctgaaggccatttaaaaccaatccatgtgtagatgtattcc

SEQ ID NO: 102 - DNA, 71 bp, Homo sapiens
ttcattcttcctttcccgttaacctctttcctctctggaaagcacgtggaaacgctgaagggaggagtgag

SEQ ID NO: 103 - DNA, 75 bp, Homo sapiens
gaggttggaatgggttgctggcagattacaattgatttcatgccagtctgaccttgcaccacattctgtgatctt

SEQ ID NO: 104 - DNA, 82 bp, Homo sapiens
actgtgacctttaattaacattgcttttgtaacactgtgtttctagatataggagtttgccttgttatttaaagcaagcagt

SEQ ID NO: 105 - DNA, 72 bp, Homo sapiens
ttgctgaagttctaccttctcacaaggttgctaaagtgaagcaacttcaagaggaggggaaacgggtagcaa

SEQ ID NO: 106 - DNA, 83 bp, Homo sapiens
gtcctgaaaccctgctctattctgactttaagaacaaatatcatgtttctaaatttacagaactgagaaccaggcctttggac

SEQ ID NO: 107 - DNA, 90 bp, Homo sapiens
tgtaataaaaatgtaaactcagctgtttcacagacataaaagtgatttatatcacatgtactgtgctcatggagtttttctttttataca

SEQ ID NO: 108 - DNA, 70 bp, Homo sapiens
tcactgatgtttgctttgcagtgttttcttgcagaaaattgcaagaaagagcttgaaacaattttggtga

SEQ ID NO: 109 - DNA, 82 bp, Homo sapiens
gaatctgcattttgaaatgagggctgcgtggggccagccgctcccatttgctcaaagccccatatttagggtgaccagattt

SEQ ID NO: 110 - DNA, 81 bp, Homo sapiens
atctgtctcataatgcttataagcttagcagcaataaactttgctaaatactaagtttgagaaaatgccgtgcaggcagat

SEQ ID NO: 111 - DNA, 85 bp, Homo sapiens
ttccaaaggcagtaaaaatgtcccagaagatctggtaatgatttgttacccagagttttaaatggaatatgtaactgctgaggag

SEQ ID NO: 112 - DNA, 75 bp, Homo sapiens
gctcccttggaaaagacacttaaccacagtgagctttactgttcactgtgcttattatccattttaattaggagc

SEQ ID NO: 113 - DNA, 84 bp, Homo sapiens
ctgcctagagaaagtatcttgtttggagcttgctggctatttttagccagtatttttagcatttaaaaatactccaagaggcag

SEQ ID NO: 114 - DNA, 79 bp, Homo sapiens
caggctgaggcagtcagatgtggtattgtaaaatggcaattttataattaagtgataattacattttctgcaatgtgtg

SEQ ID NO: 115 - DNA, 72 bp, Homo sapiens
ggcagtactagaatttatcaacggcttgttctctctggaaccagctttcattgatcaaatctgtttctagcc

SEQ ID NO: 116 - DNA, 84 bp, Homo sapiens
ggagagggatgtttggcgcaattgcagttgttaaaatagaacaggcttctgaattgtggccagaacataatgaatcccatttct

SEQ ID NO: 117 - DNA, 76 bp, Homo sapiens
ctcgatctgtctaaacacaatttgacatgcgttgctattagcttagcaccttatcaaataatgcggcctgatcgag

SEQ ID NO: 118 - DNA, 71 bp, Homo sapiens
agatctgtgtcacatttttctggtgtattttatggtgggaaaattcaattggaaaaaatgtacttagatct

SEQ ID NO: 119 - DNA, 86 bp, Homo sapiens
agtagcttgtcatggattattgagtatttactgtatgtttatactgtaattctctgaaatgacatacagtaattgctttagctact

SEQ ID NO: 120 - DNA, 78 bp, Homo sapiens
cggagccgcccgcgccagcctctccatctcgcaagttttaattaacgctgagggagaggcggctgacgggcgggtcgg

SEQ ID NO: 121 - DNA, 72 bp, Homo sapiens
caggaataatagaagtgtatttttccatttgcagagctgtaaaaaggaaacgacatttttatttgttatctg

SEQ ID NO: 122 - DNA, 84 bp, Homo sapiens
ttgtctgttttttccaccccatttctttttcctccatgtcaacaccaaacaagacaggactaaaattaatggggaaagcagcaa

SEQ ID NO: 123 - DNA, 72 bp, Homo sapiens
tgtatttaaattttaagactttattttctcactattggtgtaccttataaatgtatttgaaagttaaatata

SEQ ID NO: 124 - DNA, 78 bp, Homo sapiens
gtaatatgatacagtttgcaaaataatgttgttgacattgatttattaatattgatttctaagctgtaaaatatagac

SEQ ID NO: 125 - DNA, 84 bp, Homo sapiens
tacacacaagttagatggaatttttagagtgaaagaattaagtaggatttaattgggtgctttgtaaatagtcaactgtgtgta

SEQ ID NO: 126 - DNA, 76 bp, Homo sapiens
cccgtaagggtgcttgcatgggaagtttgtttaattacctcctttaaactcccctgttgcacatggccttgtcggg

SEQ ID NO: 127 - DNA, 78 bp, Homo sapiens
gtggccttgttcttcatttcagtgttaatcagctaaacagaagttgttgcttatgatgtgtgagtgaacatatgccac

SEQ ID NO: 128 - DNA, 87 bp, Homo sapiens
agtccacagagaaggctggaggaggtagcaaggagatgctgtaacagctgctacagccttaaaacaaagttggtgtctctctggact

SEQ ID NO: 129 - DNA, 84 bp, Homo sapiens
agcattcttggctcagggtgatgaaataaataggacttaatttatattttaaagtctttttatctctctgtaagcccctgtgct

SEQ ID NO: 130 - DNA, 73 bp, Homo sapiens
gagatcactggagaatccacaagtttaaagattctcttccagaatgtttaatgtgctttctaaaggtgagctc

SEQ ID NO: 131 - DNA, 70 bp, Homo sapiens
ggacaaaagaatatttgtttaatagtgtcagaattcattttaacaccataaaaaggatatgtatttgttc

SEQ ID NO: 132 - DNA, 76 bp, Homo sapiens
taattgcctgaatcgccgggttacatatctgttaggaaatctcttggcaatataaagaaggggctcaggacagtta

SEQ ID NO: 133 - DNA, 78 bp, Homo sapiens
tagatgggaatttgagtggcattgtttctcaggcctgctggaggctgggggatagtaaattttctcaaataccattta

SEQ ID NO: 134 - DNA, 90 bp, Homo sapiens
tatgaattagagtgattggttgattgatcagggcacctgttgtaaatcataactgttccaaacaatcactagccggtgctttaatttgta

SEQ ID NO: 135 - DNA, 83 bp, Homo sapiens
gccttaacctttttatcatttatcttcttgtattaatgtcactgaattattaattcatgagccaggatgggaagggtgaaggc

SEQ ID NO: 136 - DNA, 77 bp, Homo sapiens
attttctgagtgttaaaattatctctttttgcactgtgaaaagagcatatatgattcatgttaatatttctgaggat

SEQ ID NO: 137 - DNA, 75 bp, Homo sapiens
tggtgaaaaagaataaagtagaaaatgaatggcaccagattgtgtccatgatttatcattttaatcttgtcacca

SEQ ID NO: 138 - DNA, 78 bp, Homo sapiens
ttctgaattcatctgcaaagtgcatccagtgatgacggaaatctgcagctggatgtatccgttgcagcaaagaaagag

SEQ ID NO: 139 - DNA, 89 bp, Homo sapiens
gctggctcctgctcagagtgacagcaccctgtggagtctgctggtactgacctaaccaccacagagccccactggagcatggagccagc

SEQ ID NO: 140 - DNA, 84 bp, Homo sapiens
gcagaccgtgtttcccagcaaatgaacctacgggtggcttttcctagaccccaaagaggtgaattgcatttaaatacagtctgc

SEQ ID NO: 141 - DNA, 83 bp, Homo sapiens
tgatcaggcgcttgatatgacaggctgtgggagtcaggaccccttgaacagagtgggccttgtctgtcacagtccgcctgaca

SEQ ID NO: 142 - DNA, 87 bp, Homo sapiens
ttgaggtctagatggacaagagtgtaagcatccttcaactgagaaattcaattcttaccttacctcttccaaatctatctgacccaa

SEQ ID NO: 143 - DNA, 73 bp, Homo sapiens
ggtagccaatgatataggtaggaaatagaaatttctattttgtttctaatccttgctatatgcagtgctaacc

SEQ ID NO: 144 - DNA, 90 bp, Homo sapiens
cttctggcttggctttccctgggaagaaaagctgaaaactttcttggtactgagccattctcccatctgggataaagattaagaaagagg

SEQ ID NO: 145 - DNA, 79 bp, Homo sapiens
ccgccagctttgtagcggttcctgcttacaaaagggctcttcttggaaacggggctggtggggaccgtagagggggtgg

SEQ ID NO: 146 - DNA, 81 bp, Homo sapiens
tgtaaaacagggcttatgtttcagtttgttttctgttctgttttaaacagaaaataaaaggagtgtaagctccttttctca

SEQ ID NO: 147 - DNA, 80 bp, Homo sapiens
ctgttgagtgggtgttggtgtgggtaacaataatgttgttttcataatatgtgctggcagattagcacacttctctacag

SEQ ID NO: 148 - DNA, 82 bp, Homo sapiens
gctcataaaattaatttatggatggctttatttgatgtttggaaacaggaatacaaatgaaccaactttgatgtttatgagt

SEQ ID NO: 149 - DNA, 73 bp, Homo sapiens
acatttacgaagggttgatgcttattttagtgatgatttgtcattaaaattatgtcaaaatgtcttaaaatgt

SEQ ID NO: 150 - DNA, 81 bp, Homo sapiens
tttgtagtacaggaagacttcatgaaagcagtcagaaaagtggctgattctgacaagctagagtctaaattggactacaaa

SEQ ID NO: 151 - DNA, 74 bp, Homo sapiens
agtgtagcattttaagtaggtgttataaatctctgccaaaggcacattcatagccctgcttgaatagtttcatt

SEQ ID NO: 152 - DNA, 80 bp, Homo sapiens
ttccattttcctttaattaaggctctgtggaggtgtgtttgaaaacagagggtctcctatgcctttgaggagggtgagaa

SEQ ID NO: 153 - DNA, 79 bp, Homo sapiens
atgatggatgatcccataaggaaccaaacaagatcagtggaattcattgatttgccgggtgccctgggaattctttcat

SEQ ID NO: 154 - DNA, 80 bp, Homo sapiens
tagcaatttaatgttggaggtttgtatgaacttgaagcttatttcagttggttgcctggaaccttctgcattctttgctg

SEQ ID NO: 155 - DNA, 83 bp, Homo sapiens
ttcaaattagctcataaatattgcattatggattaggtactttacctctaaataacttgtgcctttttatggcttattttgaa

SEQ ID NO: 156 - DNA, 81 bp, Homo sapiens
ctgttggctgttgattactctctgtgtaattggaaaagctctctattcccatagctttatgtaatatatcaacagtaatag

SEQ ID NO: 157 - DNA, 72 bp, Homo sapiens
ttgaatacttttctgacaaggttcctatttgtagattcacaagtagaactaatgtgtgttaaagctattcag

SEQ ID NO: 158 - DNA, 71 bp, Homo sapiens
tgacgactggccccgcctcttcctctcggtcccatattgaactcgagttggaagaggcgagtccggtctca

SEQ ID NO: 159 - DNA, 82 bp, Homo sapiens
ttgcaatcaatgagctaataataatggtggtaatgatgaggccaagttattattacttattacctttaatcatcgacagcaa

SEQ ID NO: 160 - DNA, 73 bp, Homo sapiens
agcagctggccatactggacactttatatgaggtccacgggctggaatctgatgaggtggtatgatggctgct

SEQ ID NO: 161 - DNA, 73 bp, Homo sapiens
gtaatatatttttatattttgaaatgtactgtagatgttttctagaggcatgaaagttaaatgtatatattat

SEQ ID NO: 162 - DNA, 78 bp, Homo sapiens
ttatggccatttattatcattataaaatgtgataatgtcattgctgacttacaaagatgatgacctgaaaggccgtga

SEQ ID NO: 163 - DNA, 79 bp, Homo sapiens
tgtgagtgggtttggggtgaggctatggggagggcggggtgccgccttgcccagcccctgagggccccagcccagtaca

SEQ ID NO: 164 - DNA, 77 bp, Homo sapiens
tgtttaatagatacgtatcttattacatgtttgatacacctcattaaacatatgattcaatcggtatttatttaaca

SEQ ID NO: 165 - DNA, 76 bp, Homo sapiens
cagccatttttgtacatgttgtatagacaattgtgccttttaggagctttatgtttagaaactgtacagattgttg

SEQ ID NO: 166 - DNA, 86 bp, Homo sapiens
gtcaggtagagtaaaaactttgttaatttgaaatgcaagagaccagaaaaatgagctctgaattaattgggtttggattatctgat

SEQ ID NO: 167 - DNA, 84 bp, Homo sapiens
tctctttctctttttgtaaatataccgtcatatataagctaaaatttctcttagggtggtggggtttgctggcagggaaaggga

SEQ ID NO: 168 - DNA, 84 bp, Homo sapiens
gaagctgagaggcaaaatgtcatcatatgcattttttgtgcaaacttgtcaggaagagcataagaagcagcagccagatgcttc

SEQ ID NO: 169 - DNA, 79 bp, Homo sapiens
gcgatggcatggactgtggtcatgagtccttccatgataccaaaattgtcatggatgaccttggccagaggtgctaagc

SEQ ID NO: 170 - DNA, 88 bp, Homo sapiens
tggagattgtgtgtctggctatgtcaggccagggtggccctttttaggcagaccattaaggcaatctggctgccagatgaagtcttca

SEQ ID NO: 171 - DNA, 77 bp, Homo sapiens
ccacgtatgccatctgtctgtgtgtgaagatttttgacactgtcctgatcagcccgcagacagttattgcaaagtgg

SEQ ID NO: 172 - DNA, 83 bp, Homo sapiens
cttctcttattctccctgttttcatcctacttttaagtaataaatttggcattagtgggaggggagcagggaggaaggagaag

SEQ ID NO: 173 - DNA, 73 bp, Homo sapiens
ggatgatttctgtggctgtgtactcgagtttctggaagataatctaaaattgagaagcaggccagtgttatcc

SEQ ID NO: 174 - DNA, 74 bp, Homo sapiens
caataggattctgcctttgtctttagagaaaaggcctctgaggacatttgtgcatttgtttgaggattctgttg

SEQ ID NO: 175 - DNA, 77 bp, Homo sapiens
cacggggaccttctggaggtaaatctgcagaatggcattttgtttgtgaattctcggatcgaccgcgagaagctgtg

SEQ ID NO: 176 - DNA, 85 bp, Homo sapiens
tgcaggaaaatcagtaacattagtcatcttaaaagggttattactcaagatgatttaaattgtgaaaatgtcagtggagcctgca

SEQ ID NO: 177 - DNA, 77 bp, Homo sapiens
ctgtgttttaatcgcttctttgtcttcttcagttgcttgttatgcttgaaggagtcgaggtgggtgagaactcccag

SEQ ID NO: 178 - DNA, 76 bp, Homo sapiens
tgttttgaattgcaaatattcagttttgcatatatttaaaagttattttgacagtatgtaatgtagatttaaaaca

SEQ ID NO: 179 - DNA, 81 bp, Homo sapiens
tttgaagcttcatccaccaaagttaaatagagctatttaaaaatgcactttatttgtactctgtgtggcttttgttttaga

SEQ ID NO: 180 - DNA, 88 bp, Homo sapiens
ttacttttgtagattaaaatcaatgggatttttgcaattaatgacaaaattgcatataatggtcttttggtattaatagacttagtaa

SEQ ID NO: 181 - DNA, 79 bp, Homo sapiens
catctggctctcacttgccccagtgctatctctatggagctcattgtactgcaatggctgtgatatcgggagccaggtg

SEQ ID NO: 182 - DNA, 70 bp, Homo sapiens
gtggcttgaaaattaactgaattatgaaagctgaaatgttgctcataggatcagttaatgacaaggtcgc

SEQ ID NO: 183 - DNA, 84 bp, Homo sapiens
ttgattgatttgtaacactttaaaaaacattttctaggcaaagcacattaggagagtgttttataatgtattcagtttaattaa

SEQ ID NO: 184 - DNA, 73 bp, Homo sapiens
cattgtctgaattactgaaggtcaacttatctgataaaataggtgagctttgtggtaatgaagtcagataatg

SEQ ID NO: 185 - DNA, 84 bp, Homo sapiens
agttcttgtagtccacgtcgctgactaaggtctggcacttcttggccaacaccacccccagcatgtccactgggctgctgaact

SEQ ID NO: 186 - DNA, 90 bp, Homo sapiens
gtcttgctttcagactcttattggtattgtcgtggtgcttaattaagcataatactagcataaacagtatagtcatggaatgctggagat

SEQ ID NO: 187 - DNA, 88 bp, Homo sapiens
gaatttgccctacggtgtgaccccagcctctccctctggccacagccagggccggcggggggcctctgggagcatcttcagcaagttc

SEQ ID NO: 188 - DNA, 86 bp, Homo sapiens
aatcttcaaaatgctatctaatgtctcattaagacttgcatataatgtatcttaagtacagtcattaaatatagtttagggagatt

SEQ ID NO: 189 - DNA, 71 bp, Homo sapiens
ttggtgacgtctccatgttgtattgtctcaagcacatatggctggacagcaaacatggagagaatcatgaa

SEQ ID NO: 190 - DNA, 88 bp, Homo sapiens
aaatccagggggaagagtcatctaagtttaccatgcagttgtttaccaaaaatagaggaggagagtcttaacttttgctcttggattt

SEQ ID NO: 191 - DNA, 74 bp, Homo sapiens
tctggcaggcggtaattgctggccagctgcagggattacagccctgtgagctgtgttcagggccctgtgccagg

SEQ ID NO: 192 - DNA, 80 bp, Homo sapiens
gttggaaggcacagttaaagggtcatgtgaccaaggagggaaatgcctttgtcacatgactttttggtggcctgattagc

SEQ ID NO: 193 - DNA, 86 bp, Homo sapiens
ggccttcacccgggcagccaccttgtctccaggtctggccacgtagtctcctgaggcagggatggccccacagaggggtgggggcc

SEQ ID NO: 194 - DNA, 90 bp, Homo sapiens
tacttcagaggatcagaaagaaataggcaacaagaggaaaattgaatcatggaaatatagtagctatttctttttgaaccttacagagta

SEQ ID NO: 195 - DNA, 76 bp, Homo sapiens
attaagggtgcagttggggtgggggcagcttctgaaacagataagaggtaattgcctgcctttgactcctcttgat

SEQ ID NO: 196 - DNA, 71 bp, Homo sapiens
gccgcagactgttttcaccaactgtcacctccccaggagggagctgttggtctagcacccacagctgttgc

SEQ ID NO: 197 - DNA, 70 bp, Homo sapiens
ggaaatatactaagtgtgcattaaatagacaactttaaataatggcacttgtgctaagaagtgtattttc

SEQ ID NO: 198 - DNA, 71 bp, Homo sapiens
cagactaaagacctggattagcaagaaaaagctcttttgctctatttcagttgctttaggttgttaatctg

SEQ ID NO: 199 - DNA, 87 bp, Homo sapiens
agctgttatcttgaaagctgctacaggctataagctcttagagggtcctggagctcagagtctgtttgtattcatttttaataagct

SEQ ID NO: 200 - DNA, 84 bp, Homo sapiens
tggtgctttgaattaatgtgcaagctgttaatctccgtagacctggatttaaaattagacaaagcaataattagtttggcacca

SEQ ID NO: 201 - DNA, 82 bp, Homo sapiens
ccagggtcttctgtggcagtgatggcatggactgtggttataagttcttctatgatgccaaagttgtcacggatgaccttgg

SEQ ID NO: 202 - DNA, 86 bp, Homo sapiens
atggagatttctagcccttctaaagtctattaaaaacctttaaattctgctttagacaaaacataaaggagggttgggagctctgt

SEQ ID NO: 203 - DNA, 70 bp, Homo sapiens
tccttgagggtgttgcaatcatacatctccaggccccttggggttcggagacagtagacactcacgggga

SEQ ID NO: 204 - DNA, 74 bp, Homo sapiens
ccaagcctggtagctggagccccaggaagttgttaaagcaattaaaggcttctgtctcccagcacattgcttgg

SEQ ID NO: 205 - DNA, 73 bp, Homo sapiens
gtgcataagggaagaagacaagaaaatgatattgtcgtttaatagttcactttagatcttcatctcttatcac

SEQ ID NO: 206 - DNA, 79 bp, Homo sapiens
tggggtggcaggtattagggataatattcatttagctttctgagctttctggggagacttggtgaccatgccagctcca

SEQ ID NO: 207 - DNA, 72 bp, Homo sapiens
ggctcggtttcaaatctctcctaatccactaatgaacctttattaaagtgggagagagaggttgaatcagtc

SEQ ID NO: 208 - DNA, 85 bp, Homo sapiens
aattcccttttgagaaatgaattcccatcacaagggctttgtgggtgtgtatgtatgggaaaataattttgagcaattaggaatt

SEQ ID NO: 209 - DNA, 79 bp, Homo sapiens
gtatgcatagtcacaacataaatatatttaacatttaagaaaatttagatattctactggtaaactgacatatgtatac

SEQ ID NO: 210 - DNA, 81 bp, Homo sapiens
ttggatatgctcaatgaccagagaatctacatctaaacccttaagttcagcattactctctgcgtttttaagcatatgcag

SEQ ID NO: 211 - DNA, 73 bp, Homo sapiens
gcggcaagtgggtttgtcacgtattaatttttcattgctgtggagagttgtacatacataatcacttgattgc

SEQ ID NO: 212 - DNA, 84 bp, Homo sapiens
ttcaggaatgtacatctaattgacactacattgcattaatcaatagctgtattttttgcaaactgtggttatgacagtcctgaa

SEQ ID NO: 213 - DNA, 78 bp, Homo sapiens
cggagccgcccgcgccagcctctccatctcgcaagttttaattaacgctgagggggaggcggctgacgggcgggtcgg

SEQ ID NO: 214 - DNA, 87 bp, Homo sapiens
agctacaccagaatgaggaataaaggggtttacatatgttccaattctaaacctatcaatcaaacccatgttattcctttgggagct

SEQ ID NO: 215 - DNA, 83 bp, Homo sapiens
ggcccttaggaaattagagtgtgtttgaatttcacaagtataattttaattatacaaattttgcattttttcactagggagcc

SEQ ID NO: 216 - DNA, 77 bp, Homo sapiens
ggacccagctgccattgtggaaggtgtcatactgctggtccagcatgagcactttgcactcataccagccctggtcc

SEQ ID NO: 217 - DNA, 87 bp, Homo sapiens
tactcattttgggtttataactatcagttcttctcttccttcctgttttaagcaggaagtgctgatagcattctatataaataagta

SEQ ID NO: 218 - DNA, 88 bp, Homo sapiens
ggagtcttcatcactgatgccagccatcaggtacttgaggcctgtgatccaggtgcgggcctcctcggggttggaggtgatgaggtcc

SEQ ID NO: 219 - DNA, 62 bp, Homo sapiens
gggccgggcagcgtggtgccctggctgggtccggccgcggggcgcccgtcccgcccgcgccc

SEQ ID NO: 220 - DNA, 76 bp, Homo sapiens
cactggaaagatataaatgctaaatactgtttaactttattttattagagtgaatattatattcttttttccagtg

SEQ ID NO: 221 - DNA, 77 bp, Homo sapiens
ggctctgcaccaggcgtttcttcttgtgtttcctcttctcttctggagagggatgaaggagatcctttgtgagaggc

SEQ ID NO: 222 - DNA, 89 bp, Homo sapiens
tggtgtttttaaacaatgaatgttgttttcctttagccataagggaattttaaaacttgacaaactcattcagctttcaaagcattcca

SEQ ID NO: 223 - DNA, 83 bp, Homo sapiens
agtgggggcacgttcaagaatgctaatgaattatcagttttctttaagcctcattagatttcttgatagcaaaacctcccatt

SEQ ID NO: 224 - DNA, 77 bp, Homo sapiens
gtctgtcacccttgattggaaagtaataattcataaaacttgatgttattatcgttcctctgcctggagtgatagat

SEQ ID NO: 225 - DNA, 89 bp, Homo sapiens
gatgcttagaaaatccttgagctattgaaaggcacacctgcgttgcttggtaggtgtactgaatctcaagtaaggaatttctgcaaatc

SEQ ID NO: 226 - DNA, 85 bp, Homo sapiens
tccctcctgtgtggttttgtcttgcttcttcatggtccatgatgccagctgaggttgtcagtacaatgaaaccaaactggcggga

SEQ ID NO: 227 - DNA, 84 bp, Homo sapiens
agttcttgtagtccacatcgctgactaaggtctggcacttcttggctaacaccactcccagcatgtccactgggctgctgaact

SEQ ID NO: 228 - DNA, 77 bp, Homo sapiens
cagagggatatgctgtagagtgttttattgcctagttgacaaagctgcttttgaatgctggtggttctattcctttg

SEQ ID NO: 229 - DNA, 71 bp, Homo sapiens
gggagtggggggatctgtttggcaactggagtgaagggattgccctccccctgctgggatccccccagccc

SEQ ID NO: 230 - DNA, 84 bp, Homo sapiens
gtcagttttactaatagtcatttttctaagtcaaatgctttaattaaagttggaatgaaaaatctgattaaaatctaaattggc

SEQ ID NO: 231 - DNA, 88 bp, Homo sapiens
cctgtgtctctccgttacatctgatttgcggttcccataaaaaggcccacatgccgctgtttcagatgtgttttggattgaaaatagg

SEQ ID NO: 232 - DNA, 70 bp, Homo sapiens
ggcctttactggggttgcatttctagtgtgtcagcatttcctactcactaagagtaaattccagggggtc

SEQ ID NO: 233 - DNA, 89 bp, Homo sapiens
acagggtaaatttatgagagtgcataaaattctttatttagaacaataaagtatatgtatatatcatgtaattttaaattcaaacctgt

SEQ ID NO: 234 - DNA, 71 bp, Homo sapiens
ccccggcgaggggtgtcagattgagtgctctgtgcgcatgtgcgaaggtgtccaaactgacaatgctgggg

SEQ ID NO: 235 - DNA, 76 bp, Homo sapiens
gctcctgctccgccgcgggagctgctccggcggccgcagggctcgctcgggaagctgaggcggcggaggctggagt

SEQ ID NO: 236 - DNA, 82 bp, Homo sapiens
ggctaatcttgaggcccatcagttgccccagcttatcttttgggttattgcaattctgaatggagctttaatcagcttagcc

SEQ ID NO: 237 - DNA, 74 bp, Homo sapiens
tacaactaattaatctgctggagctgatgaaatgttacctctgcattttttgttccttgtatacaattattgta

SEQ ID NO: 238 - DNA, 77 bp, Homo sapiens
ttcaataactctgaccattgtggaaaaatgccatgtgccaacagcgattttccataattttgttcagaaaatctgaa

SEQ ID NO: 239 - DNA, 89 bp, Homo sapiens
gcattgtggttacccaaggcaaaattaagcgtaaaaacatattgcctctgaggcagaacaaaatcgcttcttgcagggaacaatattgc

SEQ ID NO: 240 - DNA, 88 bp, Homo sapiens
gtccaccttccagcagatgtggatcagcaagcaggagtatgatgagtcaggcccctccattgtccaccgcaaatgcttctaggtggac

SEQ ID NO: 241 - DNA, 84 bp, Homo sapiens
ggctgagactcttatgttgtcatggtgcagctaacagggtgagtgaactgtttcatgcttcatcaacaattaagttaattagct

SEQ ID NO: 242 - DNA, 89 bp, Homo sapiens
ttttgtataggtatttcataacaaaaatatgtatttcttttttgttattttatcttgaaaacggtacatattttagtatttgtgcagaa

SEQ ID NO: 243 - DNA, 77 bp, Homo sapiens
gctcggcgctgcagaggcctttgttaggtaaaacactgttgtcaagcctaacaagcaggtcatgcaatttgctggac

SEQ ID NO: 244 - DNA, 71 bp, Homo sapiens
ctggattttccaggacattcacatgtgtaaccaactctgtggctatgcttggaatctactcctggctccgg

SEQ ID NO: 245 - DNA, 79 bp, Homo sapiens
aagcttaagtgaggatttccttgcaatgagtagaatttcccttctctcccttgtcacaggtttaaaaacctcacagctt

SEQ ID NO: 246 - DNA, 78 bp, Homo sapiens
gtctctggcttctgtttcttatgctgctgttgattttttccaaccatcagctcagatactgacagaagagaaaggggc

SEQ ID NO: 247 - DNA, 89 bp, Homo sapiens
gcagctgaagttgaaaagaagaaagcgggtctttgtatgtgattttcatttgataaggatgctgagtgctacagtttgattttatttgc

SEQ ID NO: 248 - DNA, 78 bp, Homo sapiens
tggcctgacgtgaggaggagggacttttcgaagttttataggaaagtttccgctttccagtccccctcccccgtccca

SEQ ID NO: 249 - DNA, 70 bp, Homo sapiens
gcggtgactgacaagcctttcgctgagtagttacaaatgggactaatggtttaaacttgttagtcattgt

SEQ ID NO: 250 - DNA, 78 bp, Homo sapiens
tccaagcatgaactaatgttggggttgtggctgataagtaaggaacagctaaacaggctttgacatggtggctctgga

SEQ ID NO: 251 - DNA, 78 bp, Homo sapiens
agcacccggagctggcagacaagaatgtgcccaaccttcatgtcatgaaggccatgcagtcttccaagtcccggggct

SEQ ID NO: 252 - DNA, 73 bp, Homo sapiens
gcctataaaacagtgtccttattttggccttataattaagtaataataaaagggctgcactgttttacaaggc

SEQ ID NO: 253 - DNA, 72 bp, Homo sapiens
gagtttcaaggtgtggccccttgtaacattcatgagactggctataaaaaattgccattatttttgaaactt

SEQ ID NO: 254 - DNA, 73 bp, Homo sapiens
cgagaagtcgatcacctcgtcctccgtgccgtggatgatgagcacgggcgacgtgatcttggacaccttctcg

SEQ ID NO: 255 - DNA, 85 bp, Homo sapiens
taaaatgcatttaggggatatgaaggtcacaattgaagtgtgaatttattttagttggtttgagtttcaattctaaatgctttta

SEQ ID NO: 256 - DNA, 74 bp, Homo sapiens
ggctctgggaaagccttcctttcccggctggcctggcattcaaagccagacaaaggggggctttctctctcgcc

SEQ ID NO: 257 - DNA, 86 bp, Homo sapiens
tgttggtgacaatgcttagaaagggaagctgaatatttataatactttatttcatacagctgtcttctaaagagcagtcatcaaca

SEQ ID NO: 258 - DNA, 70 bp, Homo sapiens
gtgtttgtgtatgtatgtctgtaggggttgggtagccagtgcaatcccccaaactgctgtatgcaaacat

SEQ ID NO: 259 - DNA, 82 bp, Homo sapiens
gcccatttccctaatggcagccgattgccatttgctattcaaatcagactagataaattacagtacatgccagggaacaggc

SEQ ID NO: 260 - DNA, 78 bp, Homo sapiens
tctgtctactggatttgtatgatataaagagggttattgaaatactgtaactttaatattttttatcctgtagataga

SEQ ID NO: 261 - DNA, 87 bp, Homo sapiens
ggcgatgccagggcccctcccccaccattgttctggagagaccataggtccatctgttgccccatggtggggcccctaggcagtgcc

SEQ ID NO: 262 - DNA, 72 bp, Homo sapiens
cagagcttcattgagttatcaatgtttccacttgatctattgacaatggaggcttgaaagtaaacagctttg

SEQ ID NO: 263 - DNA, 90 bp, Homo sapiens
ggaattcagagagcagcttatttatatgtagatgtagctatatgacattttcaaatgccatacatttgcatatgaaggtctcttttttcc

SEQ ID NO: 264 - DNA, 73 bp, Homo sapiens
gttgcaaaagtgaaaaatatttctgtttgcagttaattttagtggcaagcagatcatgttaactggatgtaat

SEQ ID NO: 265 - DNA, 81 bp, Homo sapiens
ggcggtaaaacatccacaaagcctgtagtgcaatacaaattatctacagctttcagatgtttattttactaattatctgcc

SEQ ID NO: 266 - DNA, 73 bp, Homo sapiens
tctgttgtattccgaattcttaagttatgcagcttagcagctgtgataatgtaatggtttgcaaaataataga

SEQ ID NO: 267 - DNA, 74 bp, Homo sapiens
acatggctgaacaagataagggttttattcttgtgttagggacgtgctggggctgggatggaattcagctatgt

SEQ ID NO: 268 - DNA, 89 bp, Homo sapiens
actttgtgctttcactacatcctggcctagcagtctgtagcagcaggctagagagataaggccttctggtaataaataaagtagaaggt

SEQ ID NO: 269 - DNA, 90 bp, Homo sapiens
tctgattaagccgttctggagtggtgccaggcctgagccagccccaggaaaggcaggaaagaggctggtggcacaggatgggaaatcaga

SEQ ID NO: 270 - DNA, 68 bp, Homo sapiens
tcagaaaaagaaaggttatgaaattttataacagatgacaaattggtagcttttccccacttttctgg

SEQ ID NO: 271 - DNA, 79 bp, Homo sapiens
gtggtaatgcctcatgccaactttcccaaagtaacctgggtgatatttgtcaaagttgatcctgtgtgatgcatgccac

SEQ ID NO: 272 - DNA, 80 bp, Homo sapiens
ataagtggaagtgtgatcaggaaaggagagacacagattttctataaatgtgtttttcttgtgataatatgtgaaattat

SEQ ID NO: 273 - DNA, 88 bp, Homo sapiens
tgttttaatgcttatttaagaagaaattgggatttagtgcttgtcggcactaatggaatcaatggtactttaatatgtgttaatggca

SEQ ID NO: 274 - DNA, 89 bp, Homo sapiens
tcactaggcttttgtattcatgtcaatgattcaggattagagtatttgaaataatcttattgagaggaatcaaaaggcccaccgagtga

SEQ ID NO: 275 - DNA, 74 bp, Homo sapiens
aattttaattagtatttttggctttaatgaaaagtgattacaaaattggcattttagctaatactgttgagatt

SEQ ID NO: 276 - DNA, 76 bp, Homo sapiens
tctgcctggtgcatctcttgccaatcaaatcagtgctgtctgcagtgtgattgctgctttagtggcaccagggaga

SEQ ID NO: 277 - DNA, 77 bp, Homo sapiens
gggcttgggtccggctcccccgccgccgcagtgatttattcgcttcacccggcggaatcaggtgctgaaccgagccc

SEQ ID NO: 278 - DNA, 81 bp, Homo sapiens
ttgttgcatctacaaaagtggaagcaatcatgtaatgtttataccacatttgatttgctttttcctttgtttatgctgcag

SEQ ID NO: 279 - DNA, 84 bp, Homo sapiens
tgtgtgcctggaggcccagtggcccacaatcccattaatgaaataggtaatgggtaaaaataaacattggccttcagccacaca

SEQ ID NO: 280 - DNA, 79 bp, Homo sapiens
gtggccaagcttgtttctcctgggggtgctcttccgaggatatctgggctgcctccggagtcgcagtgtcttgggccgc

SEQ ID NO: 281 - DNA, 87 bp, Homo sapiens
gggtgctggtggacatggacggcgtgctggctgacttcgagggcggattcctcaggaagttccgcgcgcgctttcccgaccagccct

SEQ ID NO: 282 - DNA, 79 bp, Homo sapiens
agtgattcccagggcccagcaaagggaccaagtttccaggtcagcgacattggatgccttccctctgcctctgggagct

SEQ ID NO: 283 - DNA, 85 bp, Homo sapiens
gctttggtattaggcaggatgttagcatgccagcctcatggagaaaaggaacaatggctgtttaatttgctttttatagcaaagc

SEQ ID NO: 284 - DNA, 75 bp, Homo sapiens
cctcccagtaatcactgtgtattgcattatgcaagtcagcaaattctgctcactttaatatacatgaggaggagg

SEQ ID NO: 285 - DNA, 90 bp, Homo sapiens
gcttgcccaactttggctctgtggtcctatgagccaaaatgcatacttagtgacatgtatctcacaggaaaagggaaaaaaggggtaagc

SEQ ID NO: 286 - DNA, 84 bp, Homo sapiens
aatgacacagtgttagcaaagtttctttgaggtctttggatgaaagacaacctataaactttgctgaagatttactgttttatt

SEQ ID NO: 287 - DNA, 82 bp, Homo sapiens
tcagcgtcaggaacttcatcctggcagccgacctcatgaagagcatctggctgctgttaccaggaggagagcaagacgctga

SEQ ID NO: 288 - DNA, 76 bp, Homo sapiens
tttgctggtattggttgtgttttgagaaattgtgcttatgtatgtttttctttacagattatcaatacaaagtaaa

SEQ ID NO: 289 - DNA, 90 bp, Homo sapiens
aggcccatatcctgacattgatccaagtgcggaactcccattgaagtcgatgagagtgttgtatagaaatcaatgacaggatatggacct

SEQ ID NO: 290 - DNA, 87 bp, Homo sapiens
caaagcctccgctggggctgtttcttaacacggagttacaaactttaagaacagacagctccagacggaaatccacgccaggctttg

SEQ ID NO: 291 - DNA, 71 bp, Homo sapiens
atgtgcctaagctctgttcattaatctgtgataattagacttatttgcaaaggttaacagcagtggcacat

SEQ ID NO: 292 - DNA, 78 bp, Homo sapiens
cctcttgataggcagcaagttgctgtttccattgtttcacattggcagtggactccagcagggctgcagtgagtttgg

SEQ ID NO: 293 - DNA, 85 bp, Homo sapiens
ttaaatgtcattggtctgttttaaagtaattctatttgatctctgtgaaacagatggaagtatttgttatacaaaccttatttag

SEQ ID NO: 294 - DNA, 86 bp, Homo sapiens
gtcatttgtacttatgacagcttgggcgtgatttagtgcgacctcactttgataaaagccatttaaagctcataaatatgggtgac

SEQ ID NO: 295 - DNA, 84 bp, Homo sapiens
agttcttgtagtccacatcgctgactaaggtctggcacttcttggccagcaccacccccagcatgtccactgggctgctgaact

SEQ ID NO: 296 - DNA, 85 bp, Homo sapiens
gcacagtaatgaccttgccaaggaccaagaagtgtttcttacagaattataatttcttgtaactcaatttatgtgattactgtgt

SEQ ID NO: 297 - DNA, 70 bp, Homo sapiens
actcacctctccacccaattcttgtagctggggatgtccttggcatacagcagcttgttggagggcgagt

SEQ ID NO: 298 - DNA, 75 bp, Homo sapiens
acaatatctaagaatcccaagtggagataatgctataccattggcttgtcattcattttaaggactttttattgt

SEQ ID NO: 299 - DNA, 83 bp, Homo sapiens
agcaattccaactgccccatttatattcctaagtagaggacttgttaatatggagcctgcctctggggaagtgggaatgtgct

SEQ ID NO: 300 - DNA, 84 bp, Homo sapiens
gtcatagatggcctcattgtctaccatgaagcacaatcagagtgctctagggtggtgtgagtggtgaggatgaagttgtagggc

SEQ ID NO: 301 - DNA, 88 bp, Homo sapiens
gagaattgtaatcatatctaattagagttaaaataatgtttccctttgaaatgtttaattagctctgttttattacaaaaacattctt

SEQ ID NO: 302 - DNA, 80 bp, Homo sapiens
ggattctccaaatactccatgagtgtatcctctccccaggagatgcttttgttcttatgggcctctgtataagagaatcc

SEQ ID NO: 303 - DNA, 88 bp, Homo sapiens
gcagagtgggaagagtgggaggtgaacaggatgacagacggcccaccacggctccagctgcctcttgctgcctcccaccttcctctgc

SEQ ID NO: 304 - DNA, 79 bp, Homo sapiens
tccttccaacccaaatgattatatgattaagataccagtacccagggggaattgatctgtgtataagggagggaagaga

SEQ ID NO: 305 - DNA, 87 bp, Homo sapiens
agtttgtctttatatggcctattaattaaatattatgtggtatcttaatggggaatatgttatttaacttaggccgaagactgtact

SEQ ID NO: 306 - DNA, 88 bp, Homo sapiens
aggggctagagctctggaagtacagtcaagagatacttgattattacttggtagttttgaatatatttaacagtcctcaacagcccct

SEQ ID NO: 307 - DNA, 72 bp, Homo sapiens
tcacaagagagaacctcaggtgattactcactaataagtgacaaggaaaatgattctgaggttcctgggtga

SEQ ID NO: 308 - DNA, 85 bp, Homo sapiens
tcagttcactggctatagctattaaactatgaggaaatgactgcctggaaggcagccaggtccttggcttaaaggccaactctga

SEQ ID NO: 309 - DNA, 77 bp, Homo sapiens
tctgattaataagcatccttgcctttatgcttctacaaaaagcgtttgtgctaataatgtgatgcttaataatgaga

SEQ ID NO: 310 - DNA, 78 bp, Homo sapiens
agaacatgtgctcattactgggtcttagaggctaaaagaaaaatttggcccctccacagcacagatggtatttgttct

SEQ ID NO: 311 - DNA, 80 bp, Homo sapiens
tgttgctgtagccaaattcattgtcataccaggaaattagcttgacagagtggtccttgaggacaatggctgccccagca

SEQ ID NO: 312 - DNA, 73 bp, Homo sapiens
gatttttaagatgtgacagcttgattattttacaaggccaaaaccctgattcaagcctgcaattttaagaatc

SEQ ID NO: 313 - DNA, 77 bp, Homo sapiens
acgggaaaagaggagaggcaccagatatatgttctctaggccttttagaaaacatggggtttttcctttggccacgt

SEQ ID NO: 314 - DNA, 73 bp, Homo sapiens
ttttgcttttggctgtcagctaagtagaggaaggtaagagtctttgtttgaattagagtgccaaaagacggaa

SEQ ID NO: 315 - DNA, 87 bp, Homo sapiens
tcctgggctgcccgcaacagttcctgaatgttcttggtgacctgctctgtcttcaagatgacatcctctgtgctgggaagcccagga

SEQ ID NO: 316 - DNA, 73 bp, Homo sapiens
gtaaatttcaacctatttttaagggttattttcactcaagtgaaatctatcaaggaaggagggttatttttac

SEQ ID NO: 317 - DNA, 83 bp, Homo sapiens
gtaacaggctacgaacaatctatgaatctagagatggcagtaaacaggattgctttcagtttatgagctgttaagcctgtttc

SEQ ID NO: 318 - DNA, 85 bp, Homo sapiens
tgaatgatgtccaaaaatgatggaaaagaattggcttcagaaacaaagctgtgtttctgtcagtcattttggaacatatgattca

SEQ ID NO: 319 - DNA, 81 bp, Homo sapiens
gacaagttcagagagtttgtcagttcccgtcactttcaggtctggctgtgcagtggagcacagactcaaaacagacttgtc

SEQ ID NO: 320 - DNA, 78 bp, Homo sapiens
agaagtcttacaatgtgttggggtgtgtgtttttaaggcatgaaaatacttccctcccacacaaatgtgagttcttct

SEQ ID NO: 321 - DNA, 75 bp, Homo sapiens
gcccatgaggattttgactgattccattgagcaagctcaggtcagctaagtcctttccttcaaagcatcatgggt

SEQ ID NO: 322 - DNA, 72 bp, Homo sapiens
tcttcagctgtgtgtttatctgtgtaaatgtatgatgtgtttggcagaaagaaagacagaccaagttggaga

SEQ ID NO: 323 - DNA, 86 bp, Homo sapiens
gcacagattttaattttatcccagttatggatatctggcgtgtgcgctgatactctgggcagactggtgtgaaatttaatttgagc

SEQ ID NO: 324 - DNA, 79 bp, Homo sapiens
ggttaaaatggattgccaggaaacacctgaagggtacaaagtcatgtacacccccatggctcctggtaactacctgatc

SEQ ID NO: 325 - DNA, 75 bp, Homo sapiens
aagggtctaggaaatggttttgaggtgtgaaaactgatgtttatagagagtaaactgttttctttgaaggccttt

SEQ ID NO: 326 - DNA, 78 bp, Homo sapiens
ttctttaatgaaggtttgcaatgatggaaaaacagtaggaagcattttttcaaatgcaaattaccttacaggaaagaa

SEQ ID NO: 327 - DNA, 85 bp, Homo sapiens
tgctggtcaccaggactcaaggaaccaaaattgcatctgatggcctcaagggtcatgtatttgaagtgagtcttgctgatctgca

SEQ ID NO: 328 - DNA, 80 bp, Homo sapiens
ggctggccaggctccgcccccggccctccctgcgcccggccggtgcgcagggaggtcggaggagcgggcactgcccaccc

SEQ ID NO: 329 - DNA, 90 bp, Homo sapiens
gctccccggctccctcactgcggcagccgcggccccataaatcgtgagagcgacgtgctccggagccgagaatggagagggccggggagc

SEQ ID NO: 330 - DNA, 82 bp, Homo sapiens
actgccaaagcctgaacatgggccaagtctaattatgtttgagttggaaggtagatctttattgttcgggaatcaaggcagt

SEQ ID NO: 331 - DNA, 84 bp, Homo sapiens
ctgtaaatgctcagtagctgttaatatgagtctgtcaatacatttaccatggtgacttgggctgtatttggcgagcatttgaag

SEQ ID NO: 332 - DNA, 73 bp, Homo sapiens
caggggcaccaacatgcgtgctgaggtgcagaaactgcagacgaagctcctcacatcattgtgggtacccctg

SEQ ID NO: 333 - DNA, 74 bp, Homo sapiens
ggtcccagaactgtttgcttcaattggccatttaagtctaatagtaaaagactggttaatgataacagtggatc

SEQ ID NO: 334 - DNA, 78 bp, Homo sapiens
caagtgctgtgattctgtctgacgtgtgaagattcagacaggctgtcttgacaagttgtggtggagcacctgcatttg

SEQ ID NO: 335 - DNA, 90 bp, Homo sapiens
tcataattggagcttgtctagaatctctccattccttggtgctaacatacaggattttaatcacaaatttgcagctccatctcattatga

SEQ ID NO: 336 - DNA, 85 bp, Homo sapiens
ttattttagtgccaaattttgaggagatgataataggatgtccaaatgacagcaaaattatttcctcaaatctttattgagataa

SEQ ID NO: 337 - DNA, 75 bp, Homo sapiens
gctctgcttccaggctgtatttttaggctggcatttaggtttggcctggggacaaggggctggaaaatgcaaggc

SEQ ID NO: 338 - DNA, 74 bp, Homo sapiens
aggacgatgataattacaggcggtaattactgcttttgttaggagtgtgtaattagccacatatgcattgttct

SEQ ID NO: 339 - DNA, 86 bp, Homo sapiens
ttatctatggattttctccttagatgtttaaatattccccctgtaatttaggtttcatcaaacaaaggagatctgatttaagataa

SEQ ID NO: 340 - DNA, 75 bp, Homo sapiens
aaacgggtggcagttattgctggagtccaagtggctgaatcgcatgcttggaaataggagtatattcatctgttt

SEQ ID NO: 341 - DNA, 81 bp, Homo sapiens
ccggtgcgcggccgcggcgagggcgggggaagaaaaacaccctgtttcctctccggcccccaccgcggatcatgtaccagg

SEQ ID NO: 342 - DNA, 77 bp, Homo sapiens
ctggagtgtttatggcaagtcactttgacagacattattgtggcaaatgttgtctgactactgcttcaacaaaccag

SEQ ID NO: 343 - DNA, 77 bp, Homo sapiens
gtttggctctcacctgccctggagctgtctctatggagctcaatgtactgcagtggctgtgagagtgggagccagat

SEQ ID NO: 344 - DNA, 90 bp, Homo sapiens
tacctctcacctggcagtgaccttagtatgttttcatgtttatctaaaaaagataaaaggtatgattgctcaggaatgaaaacatgggta

SEQ ID NO: 345 - DNA, 74 bp, Homo sapiens
ctcctgaaggcgtttctggtttttccatttataaagcagagtgaggttataaatcagaaaagtgtttacaggag

SEQ ID NO: 346 - DNA, 89 bp, Homo sapiens
aagcattgagccggcttcgggagctctgccgctggtggctcatgccagaggtgcacaccaaggagcagatcctggagctgctggtgctt

SEQ ID NO: 347 - DNA, 78 bp, Homo sapiens
tgctggaggtaagggttttctgaagcctggtgccatggccacatgtgcacatgagggagggagacgctgaggctagca

SEQ ID NO: 348 - DNA, 78 bp, Homo sapiens
ttaaagggaatgttatctcagtcagtctctcattaaccatgtaattagactgctgaaaataattaacattccttttga

SEQ ID NO: 349 - DNA, 84 bp, Homo sapiens
tgatacataagcttgggaaaatgttgctggatttctctgagcatagaatgcagagattcccagagttctcagagcttggttaca

SEQ ID NO: 350 - DNA, 83 bp, Homo sapiens
tgaaaggttcacaactattgttttcctcttctgactcatctttgaatcagtaaattaaatatgtataacttgtgaagatttca

SEQ ID NO: 351 - DNA, 85 bp, Homo sapiens
gcctgccagctctattctgttagcaaatttattttcttctcttagacggatgataaaaatgtcacggtgtgatgctttagcaggc

SEQ ID NO: 352 - DNA, 90 bp, Homo sapiens
gagtgatcgcacacccatccttccataatatcaatttcaagcaagcagaaaagatgatggagaccatggaccagggtgatgtgattatcc

SEQ ID NO: 353 - DNA, 82 bp, Homo sapiens
gctggcagctttcttctcagtccaggccagcagcctctgcttcttctcttgctttgtctctggtctgtactagtgggccagc

SEQ ID NO: 354 - DNA, 73 bp, Homo sapiens
tattcagcaataagaccataatttttcatatttaaggagtatgaaaaatttgtggagttttaaaagctgaata

SEQ ID NO: 355 - DNA, 89 bp, Homo sapiens
gctgggaatttgctggaggcaaaaatggagttttatctgaaatgctttattgatcatccaaccattgctgacctcagtaaatccccagc

SEQ ID NO: 356 - DNA, 70 bp, Homo sapiens
taagccagattctcaacttacgtaattctatgggaattcacagagttatattggttgagaatttggctta

SEQ ID NO: 357 - DNA, 76 bp, Homo sapiens
gctctattatacagaacagaaggaacatttggtgggttgaatacttgttaatttatttctctgtttgttaatgggc

SEQ ID NO: 358 - DNA, 71 bp, Homo sapiens
tatatgattgcgagtggaaaaataggggatagaaatcaggtattggctgtttttccattttcatttgtgtg

SEQ ID NO: 359 - DNA, 76 bp, Homo sapiens
aaggaggcacaatagtttaaataaagtggtggttttaaatattttacccatttctttaaacaaattgccaatcctt

SEQ ID NO: 360 - DNA, 79 bp, Homo sapiens
gctgcattttgattttgcattcaatctctggtccattcatggtgtctgcgctacctaggggatgcaaaattgaggcagc

SEQ ID NO: 361 - DNA, 71 bp, Homo sapiens
atttgtttactgtagctggaggtgccgagtaatgaaatgcacttgtgtctgcagctcactgctaaacaaat

SEQ ID NO: 362 - DNA, 77 bp, Homo sapiens
agtaccacctgcccagagcaaatctgatggactgacttccgatcaataggtttgatggccttagcaggttctgtact

SEQ ID NO: 363 - DNA, 77 bp, Homo sapiens
gctggggttcatcggagaaactccctgcgatgagccactagggtcacggacagggaactttttgatgagcgccgagt

SEQ ID NO: 364 - DNA, 78 bp, Homo sapiens
ctggtttgttgaagcagtaagtcagacaacatttgccacaataatgtctgtcaaagtggcttgccataaacaccccag

SEQ ID NO: 365 - DNA, 70 bp, Homo sapiens
agcccgctgctggggaagacacctgtcacccaggtcaatgaggtgacaggtaccctacggatcaagggct

SEQ ID NO: 366 - DNA, 85 bp, Homo sapiens
gtacttggtttttctaatttgacagaggataaaagaaggctttcgcggctttgttttatttctaaactcatttagcaccaagtgc

SEQ ID NO: 367 - DNA, 73 bp, Homo sapiens
tatcaaattctctataaatctttcagacagtttatttaacaaagtgtcattgaaactgtatagatgattgata

SEQ ID NO: 368 - DNA, 84 bp, Homo sapiens
gtgatgtgatttctgcccagtgctctgaatgtcaaactgaagaaattcagtgaaatgcgggtaaacggcgggagtaactatgac

SEQ ID NO: 369 - DNA, 76 bp, Homo sapiens
ggaagaaaaatctgtagcattcggagtgtgaaaaggaacccttttttcagctccaaagctgcataatagaacttcc

SEQ ID NO: 370 - DNA, 74 bp, Homo sapiens
gcttaattacaatgtgatgcctaatatattgtgatgaatttattctcaaagtatttacatatttgtagttaagt

SEQ ID NO: 371 - DNA, 73 bp, Homo sapiens
tttcctctctcctttctcctcaagctgattagcgggtcgggcaatggcgtgaggagatgctgggggtaggaaa

SEQ ID NO: 372 - DNA, 89 bp, Homo sapiens
gggctgtggcctcaatctcattggggctaaccggctggtcatgtttgaccctgactggaacccagccaatgatgaacaagccatggccc

SEQ ID NO: 373 - DNA, 87 bp, Homo sapiens
cctaacaggcttgtacctttgattttctgccatactctccaagttaatgagtaagagggtcaagggaatttattcctgtgctttagg

SEQ ID NO: 374 - DNA, 72 bp, Homo sapiens
tttccactgttgtagagaaaactagggagaactttatttttcaataaacttttcttgtgtgacaggtggaag

SEQ ID NO: 375 - DNA, 76 bp, Homo sapiens
agtagctgcactttttggaaactgtggctgtgtcagtcctgaacaagaagggtttcctgtttaagctgcagtaact

SEQ ID NO: 376 - DNA, 81 bp, Homo sapiens
tgtgtctcttaatgatgctcatttaaatactgtcaactttccattggtttaatattcatgattttgcgtcattaaaacaca

SEQ ID NO: 377 - DNA, 89 bp, Homo sapiens
tgtaaaccttaacaacccgggcagggcccttttcatctccctgatcacactcatctcaggatgaaatgggccgcagggaagggttcaca

SEQ ID NO: 378 - DNA, 85 bp, Homo sapiens
ggcatgcttgttggtggaatcaaaggtatgtttcatgccagctttttgtctgcaaagtgtctttcattccactaagaggtatacc

SEQ ID NO: 379 - DNA, 78 bp, Homo sapiens
gtactatatagtacagtattaatttatagcaggaaatcgtatcttgtaaactgtatataaaacactgttttatggtgc

SEQ ID NO: 380 - DNA, 70 bp, Homo sapiens
gggacctttgaaaggctctgtgattgctggtggtcagggtcaattgtgcagatgtctttaagagtgtctc

SEQ ID NO: 381 - DNA, 73 bp, Homo sapiens
caggaaaattatgctaagtagcttcatgttgatgtcaagaattttatgcagtgagttatggcatggtaccctg

SEQ ID NO: 382 - DNA, 82 bp, Homo sapiens
tgcatgttgaaaaataagccgttattgatcttaaacatcggtcagatgagtcatacattgggttattttttatatacatgta

SEQ ID NO: 383 - DNA, 84 bp, Homo sapiens
taattgaatagtaactatcatgtaattgcagggtaatcacatggttatttttgctttgcaaattaaagtgttactatgagattg

SEQ ID NO: 384 - DNA, 77 bp, Homo sapiens
cccaagctccttcctggaggacttaacactgtgttgagcagttgttttgaatttccgggcagggggctgcaaaaggg

SEQ ID NO: 385 - DNA, 79 bp, Homo sapiens
ctttaatattcaatgacataacttcattgcgggtttgacaacactatatagaagttgtgcttaccactgaaaattaaag

SEQ ID NO: 386 - DNA, 86 bp, Homo sapiens
ggagaccacaattataccccctttcaatgacatgtctggggttgcagtgactccagacaaagaagctgaaatgtatgaaagtttcc

SEQ ID NO: 387 - DNA, 76 bp, Homo sapiens
ggccttcagtaattacaatttttaatggctgaataatattctcccaagagattgtaattcgcttaattatttggct

SEQ ID NO: 388 - DNA, 86 bp, Homo sapiens
ctgatttagaggaagtgagtatatgctgtagaatggcccatatgccactttgctattagaatatgagtcattatttctaaacttag

SEQ ID NO: 389 - DNA, 71 bp, Homo sapiens
agctatctgtctccattgcttcttgttatgtttttaataactgaacattgacattaacaaggcaggtggtt

SEQ ID NO: 390 - DNA, 84 bp, Homo sapiens
ttccccaggcagcagcaggcgcacggccgtctggatctccctggaggtgatggtcgagcgcttgtcataatgcgccaggcggga

SEQ ID NO: 391 - DNA, 78 bp, Homo sapiens
ttataatagattacaggaagatgcttatgaaacaaatacatttgtttcagtacatgtctttaagtgatagaattataa

SEQ ID NO: 392 - DNA, 74 bp, Homo sapiens
tttgtctctggtctgtacttgtgggccagcttaagcagctgagtagctgtttggcggtccagggcctgggtgaa

SEQ ID NO: 393 - DNA, 79 bp, Homo sapiens
gtagcagggcaggaaaatgtaaaatcaataaataatcaggctgaattttaattgaatatattcctaaggccatgctgac

SEQ ID NO: 394 - DNA, 80 bp, Homo sapiens
cttctttgtgtggcaatagatagtttagattttttaatattgttagtgttgagagataaacactttggtacatattggag

SEQ ID NO: 395 - DNA, 70 bp, Homo sapiens
tagccctgctgttttgctggagaaacacagatgttgtgatttgctcctcctgaagcctgcagcagggtta

SEQ ID NO: 396 - DNA, 72 bp, Homo sapiens
gctgcttctcacagtgttaagcatctgggcttttaggcttttcagaatgctgtatactttaggaaggtcagc

SEQ ID NO: 397 - DNA, 88 bp, Homo sapiens
ggcagagccaggcaggagccagagtcagcctggggggtgatggagctgaggccatcaccggtctgacagtggaccagtatggcatgct

SEQ ID NO: 398 - DNA, 89 bp, Homo sapiens
acgcgccgtttcctagttattctgaggtgcagctataattgctgttctttccaaataaatccttcagattaaatggatatcgagtgtgt

SEQ ID NO: 399 - DNA, 72 bp, Homo sapiens
gttcgagccccggctatttgtgtgtgatcagtaaatatttagtgcgctgacatccttagctgggcttcggat

SEQ ID NO: 400 - DNA, 81 bp, Homo sapiens
ccttttatatcgacagttggtagcacaagccttttaactcacaaagggtagcagctcttcagccaatctgtgataaaaggg

SEQ ID NO: 401 - DNA, 73 bp, Homo sapiens
cagtaggttttaatttcactatttcaatttcccaaattgtatttagtttagaaatacaccatattgcttactg

SEQ ID NO: 402 - DNA, 82 bp, Homo sapiens
tcattttgtattgaatgatttttaatgaatgcaatattaatccttgcagatgagcaataatcattaaaatcgattaaaatga

SEQ ID NO: 403 - DNA, 86 bp, Homo sapiens
gtgctttctataatggcatgagtggactcagtattacaaagtgctcttttattgcatctttccaccaggccatttatatgaagcat

SEQ ID NO: 404 - DNA, 90 bp, Homo sapiens
ttaatcatctttagatgaggctgtaacttgtggagtagatataattggattagctgaaaagcggcagttgcggagctttgaagagattaa

SEQ ID NO: 405 - DNA, 88 bp, Homo sapiens
taatcttactgtcttttctatgtgatggtagtttatttatgacctattgataatctccagccagcagcagaaaactcagtgagtatta

SEQ ID NO: 406 - DNA, 69 bp, Homo sapiens
gggagtgtgctgggaactgggcagataaaaagggctggaacttattatttggctagactctcaattccc

SEQ ID NO: 407 - DNA, 78 bp, Homo sapiens
ggagcccttgatgtcctgcaaatgaaggaggaggatgtccttaagttccttgcagcaggaacccacttaggtggcacc

SEQ ID NO: 408 - DNA, 70 bp, Homo sapiens
tccaggttcattttgcaaaacaaatttaatttcttatagagaaacttgaaatttataaaagaaccctgga

SEQ ID NO: 409 - DNA, 75 bp, Homo sapiens
gcctctgcttcttctcttgctttgtctctggtctgtacttgtgggccagctcaagcagctgagtagcagtttggc

SEQ ID NO: 410 - DNA, 86 bp, Homo sapiens
ctgatctctgacatgacaggcatatggtgtttatcaataaataaaaaggatataattacgctgaggctgaagcattcagggattgg

SEQ ID NO: 411 - DNA, 78 bp, Homo sapiens
agcacagctattggtgttttgcaggaggcaagtgaagcccatctggttggcctttttgaagacaccaaattgtgtgct

SEQ ID NO: 412 - DNA, 76 bp, Homo sapiens
tgcggtatttctagaaacattacaaattctatgtgttaagctatgtaaaatttgggaactagattatcatactgca

SEQ ID NO: 413 - DNA, 89 bp, Homo sapiens
tggcattgtcttggcccctgtgcccaagaagctactcatgatgactggtatcaatgactgctacacctcagccaggggctgcactgcca

SEQ ID NO: 414 - DNA, 84 bp, Homo sapiens
gtattaaaatggaatttctgcatgcctagcaggagcttgaaccaagtccacccctgcggcagctggaagaccataaaagggtac

SEQ ID NO: 415 - DNA, 77 bp, Homo sapiens
cctgaactggcaattcagaacagtttgattgcctgcttgattgtttgcgagataactgcaagattgtcagtgacagg

SEQ ID NO: 416 - DNA, 85 bp, Homo sapiens
caatcaattagcacatgagtaataccaagcccattaggacaaactgatgccgggggagttatgtcatctgctatagaaatgattg

SEQ ID NO: 417 - DNA, 87 bp, Homo sapiens
catttactcacaatttaattgcatttttaatgctaattacaacacattaatctttaattagcattaatttgtttgctgaggtagatg

SEQ ID NO: 418 - DNA, 77 bp, Homo sapiens
ctgtgttttaatcacttctttgtcttcttcagttgcttgttatgcttgaaggagtcgaggtgggtgagaactcccag

SEQ ID NO: 419 - DNA, 80 bp, Homo sapiens
aggtgtactggatggactaagcctcagaattcttgccacacccacaagccccttctaaggagtttccatccacagaccct

SEQ ID NO: 420 - DNA, 70 bp, Homo sapiens
gcccagttaattggtctctcaacctacattagctgttgcattgcagccaattaggcaggggccagagggc

SEQ ID NO: 421 - DNA, 83 bp, Homo sapiens
ccttaaaggcagctctgcctcaaagatatcacatatgcatattaataacacacactttgtagtgcctagagttgtttttaatg

SEQ ID NO: 422 - DNA, 78 bp, Homo sapiens
attacttatttgcttttgagaaacaattttccacccaacctaatgggttataaattgtctcatttgcagctatttaat

SEQ ID NO: 423 - DNA, 76 bp, Homo sapiens
ggataatattcatttagccttctgaggcttctgggtagacttggtgactttgacagcttcagaagctttcttgtcc

SEQ ID NO: 424 - DNA, 81 bp, Homo sapiens
ttcctttatatgtattcctacatgattgtaggagtctgtcctgaacttcgatcatgtacattttggaaacttattttagaa

SEQ ID NO: 425 - DNA, 72 bp, Homo sapiens
tgggctactgttgtgaatgataatcaagtagagctctatcatttgattacaagcctcattcagtacagccca

SEQ ID NO: 426 - DNA, 79 bp, Homo sapiens
aatgtatttgttcatgtttggtgcatagaactgggtaaatgcaaagttctgtgtttaatttcttcaaaatgtatatatt

SEQ ID NO: 427 - DNA, 87 bp, Homo sapiens
cagcctgcctttcacatatccgagccctctgtgacacatcagatttaatgagactgcacagatctcaaataaggaaggggagcgctg

SEQ ID NO: 428 - DNA, 76 bp, Homo sapiens
agcaacatatttatgattaatgatggaaaatatgctttgaagatgtttttatttgcatttatagatataatttgct

SEQ ID NO: 429 - DNA, 71 bp, Homo sapiens
aatattactacataatttgtcttaaacacttttccttttaaaaatgtcaagataattatatgttaaatatt

SEQ ID NO: 430 - DNA, 77 bp, Homo sapiens
ttactgatcttggtattatcaccgtaggagttaaagtcatgagacaattttatggggataatttcttggcaaagtaa

SEQ ID NO: 431 - DNA, 80 bp, Homo sapiens
ggattctccaaatactccaccagtgtatcctctccccaggtgatgcctttgttcttattggtgtctgtgtaagagaatcc

SEQ ID NO: 432 - DNA, 80 bp, Homo sapiens
attgtgctggatcctaaaaagctaagtacattaacttggaatgtgctgagctagtggtaaattgatatccagcctgcagt

SEQ ID NO: 433 - DNA, 77 bp, Homo sapiens
gctggaacagctcaaaattgaataattaattacactcagcttcaatcgcagtgactaattgatcaggggctgccagc

SEQ ID NO: 434 - DNA, 74 bp, Homo sapiens
agtagggtatttctataacagatattattcagtcttatttcctaagattttgttgtaacttaaggtatcttgct

SEQ ID NO: 435 - DNA, 75 bp, Homo sapiens
tgttacttcccctttgtggtaatggcttgtggcacttagccagaaaacattattaatttcagaagtggactgaca

SEQ ID NO: 436 - DNA, 84 bp, Homo sapiens
agctgctggatgcttggcatttctgcttctggtgaaatgctctttgtgcagatttatctgatccagatgtgtgaccagcaagct

SEQ ID NO: 437 - DNA, 81 bp, Homo sapiens
cagcaagaggtgcaggttgagtatttggaggtggtatatttggccagactttagccgcatcgattatgctatttcttgctg

SEQ ID NO: 438 - DNA, 72 bp, Homo sapiens
tagacagccaatttggacaattcagaccccaaagtggtgtcttaggtctgatttatttgttttggctgtcta

SEQ ID NO: 439 - DNA, 83 bp, Homo sapiens
tggatagcttttcttgatctaatgaaattgcattcctatggcatttaatataaggtgcagttattatttactggagctttcca

SEQ ID NO: 440 - DNA, 84 bp, Homo sapiens
ggtgaaagtgttcgctgccagagatgcctgaactttagggttgttaaagtggttactgttccttggtttgtaaacatattcacc

SEQ ID NO: 441 - DNA, 80 bp, Homo sapiens
gtgactctggtatggctctgctgttatttttacatggtgttaatgtgttcctgacatatttcagagaccaggcttgtcat

SEQ ID NO: 442 - DNA, 72 bp, Homo sapiens
caaataaaatggtttatttgaaaccatgaactaattcaattaaaagtttatttcaaatatatgttttctttg

SEQ ID NO: 443 - DNA, 82 bp, Homo sapiens
cttcttgagaaataactaaaaagcaattgtgatagtgcaagaaaactttaacaaatattgctttaaactattattcagaaag

SEQ ID NO: 444 - DNA, 78 bp, Homo sapiens
acagcggcatggttcatgccaaattccgaagcaatcttcctgctaaggccactggacacagaatccatgtgatgctgt

SEQ ID NO: 445 - DNA, 84 bp, Homo sapiens
attatgattgtagtctgttgaatagtatttaccatggcatttcatacccatggtattttataccttctgactatcaattttagt

SEQ ID NO: 446 - DNA, 88 bp, Homo sapiens
acttaatgaagctttggatcctatagtcaatttacttaaaattactcattttggcctctagactatactgtaccaaagttcattgtgt

SEQ ID NO: 447 - DNA, 86 bp, Homo sapiens
acagaccaggcacagaaagctgaaggtgctagagatgccaagtgaaacatgtgcatttttggtaactgtgtacttctggtgactgt

SEQ ID NO: 448 - DNA, 75 bp, Homo sapiens
tgtagcattgtattcaaaataaaggggctaaagaaactaaggtctgcatcacttaaaaaagaatgtagtgctata

SEQ ID NO: 449 - DNA, 82 bp, Homo sapiens
ccaggatgcattagtggttcgacacaactgatgtgctcaggcacctccggggtacattagttgaagtggctacggcagctgg

SEQ ID NO: 450 - DNA, 89 bp, Homo sapiens
ggctgagatttatgctgattctcttgattcagtccagacttgtcaacttccctggaagcaagcagaatgttccataaattactgcagcc

SEQ ID NO: 451 - DNA, 83 bp, Homo sapiens
tgctcaggatcagcttcagagaatttataattagctcagaatagcctataataaattctttggaaagatggttttaattagca

SEQ ID NO: 452 - DNA, 78 bp, Homo sapiens
ctgcatgctagtaatttatttttaatatctttcagctggtttggctggaacttaaaaatagataataacagcattgag

SEQ ID NO: 453 - DNA, 86 bp, Homo sapiens
acagaccaggcacagaaagctgaaggtgctggagatgccaagtgaagcgtgtgcatttttggtgactgtgtacttctggtgactgt

SEQ ID NO: 454 - DNA, 81 bp, Homo sapiens
ccaccaacttgacatacacaggctcatcacagttggatgcaagcacacaaagatgggcttggcacttgtctaaggctttgg

SEQ ID NO: 455 - DNA, 74 bp, Homo sapiens
cgataattgcgcgccggcagctgcgagcaaggcccccagcccggcgcgcagccccgcccgcgcgcgatcaattg

SEQ ID NO: 456 - DNA, 82 bp, Homo sapiens
gtgtgggagagtgaattaaaaacaaacctactgggagaagagataagaattctagacatctgcgtgattctttcttccacat

SEQ ID NO: 457 - DNA, 84 bp, Homo sapiens
gtagaaagctgaaaacctgccaatgcccatctatggtttatagtagataagccattagtcttggctaggtatatcacttcctac

SEQ ID NO: 458 - DNA, 85 bp, Homo sapiens
ggagcccgagaaactaagagaaagtgtcaggagcatgttaatcagactcgttacactgtaacaataacgtctctctcgggtctcc

SEQ ID NO: 459 - DNA, 75 bp, Homo sapiens
tgcatttttctgtgtttctttctaaccctcgagaatgttaagaatttaggaagagagccacagcttaagagtgca

SEQ ID NO: 460 - DNA, 74 bp, Homo sapiens
tggcatattaagcatcataaagttaatgttaactactaatgtcaaccattaattatatgctttttaatatgtca

SEQ ID NO: 461 - DNA, 77 bp, Homo sapiens
gtgtagaattattgcttatgtcatttcttaagcagttatgctcttaatgcttaaaagaaggctagcattgtttgcac

SEQ ID NO: 462 - DNA, 83 bp, Homo sapiens
aactttgttaatcatcttttatttggtaaattatgaatgggtatacatttgtacagttcgtgtatattgattgtggcaaagtt

SEQ ID NO: 463 - DNA, 73 bp, Homo sapiens
tcttgatttgcttcattgtcctgcagtttgcaaactataatcctgtataatttcaggaacaagcaggtttaga

SEQ ID NO: 464 - DNA, 86 bp, Homo sapiens
tgaagcgaatatgcatatttcccctaatgtttctgtaatttagatttctttgtttagagccatgattggggagtaataaagcttta

SEQ ID NO: 465 - DNA, 81 bp, Homo sapiens
cggctccaggttctgcctcacagtcttggtgccctgctcctgcagcagggtccactttgtttccagaaccttgttctgctg

SEQ ID NO: 466 - DNA, 75 bp, Homo sapiens
attaatgtttttgtagcaaacaggaggcagagttctccaaaggctctcatctctgtgcttccagaaaatattgat

SEQ ID NO: 467 - DNA, 86 bp, Homo sapiens
gtgcttaagtccccactctcattttgtggcggtgacattaccgttgatggctctaatactctcataatttgaaaggggatttgcat

SEQ ID NO: 468 - DNA, 83 bp, Homo sapiens
gagaaaatctttagtattgattgatagccgcagactcctgtccaaaggtttcctctttaaattaagaatactaatgatttctc

SEQ ID NO: 469 - DNA, 89 bp, Homo sapiens
atgacatctgattgatagcttgggccaaaaaggttggcaggcctgaaggggcgggagggttaacagcccgattgtaaaatcaatgtcat

SEQ ID NO: 470 - DNA, 80 bp, Homo sapiens
gactgcacgggcacggaggtcctcattaactctgatcttcaattacattgattatcagcctgcttctgtaattgtgcagc

SEQ ID NO: 471 - DNA, 78 bp, Homo sapiens
tctctatttgactctctaagaagtaattatatatgtcttatgtattgtctttgctttcttttcagagatttatggaga

SEQ ID NO: 472 - DNA, 85 bp, Homo sapiens
ggtgtgtctgcctctctttctgcccccctataccccttgaccccagggggaaggcactcgggcagcacaaagggagcagatgccc

SEQ ID NO: 473 - DNA, 71 bp, Homo sapiens
agtatatattttatgaacattctttcctcaaatcaattgagaaagataatgttacgtctttgaattttact

SEQ ID NO: 474 - DNA, 79 bp, Homo sapiens
ccctgccagccagagcaaattgggtgcccggatgttgaggtctggttggcatttcctgtgttggctttggctggtgagg

SEQ ID NO: 475 - DNA, 83 bp, Homo sapiens
cggcgcgtccggcctccgccgcgccttcagctggctgcggggcaagcggcgcaagaagaaggcggcgggggccgagggcgccg

SEQ ID NO: 476 - DNA, 78 bp, Homo sapiens
cgagggttcagatgacgtcagcttgaataaaggtctgacctagtgaatgttaaatgtggctgagtgactgaatccttg

SEQ ID NO: 477 - DNA, 89 bp, Homo sapiens
gtgacttttaatattagcatttttgctttcaacagcaattagcaatctcttggtttgctgtttggtaaagcatcggttaatgaggtcat

SEQ ID NO: 478 - DNA, 75 bp, Homo sapiens
gggtccgggtctctaccgcgccctcatgcaggaggcccttggagcaggagggggaagcgggagacccggcagccc

SEQ ID NO: 479 - DNA, 88 bp, Homo sapiens
gatggcatcaaaggtggccttggcgaagttgcccagggtggcagtgcagccctgggctgaggtgtagcagtcattgataccagccatc

SEQ ID NO: 480 - DNA, 80 bp, Homo sapiens
tacattcagtgagaatactttgggtttcaggaaatacgcatattttatcacagacagtccaaagtgtgctcccaaatgta

SEQ ID NO: 481 - DNA, 81 bp, Homo sapiens
tgtgaagccacaggaaggggctctgtgacatcacaggtaggggcagtgtgaagtcacaggaaggggctgtgggaagtcaca

SEQ ID NO: 482 - DNA, 76 bp, Homo sapiens
gtcttggcagtgcagatgaaaaactgggaaccatttgtgttgggtccagcatttgacatggacaagatgccgggac

SEQ ID NO: 483 - DNA, 82 bp, Homo sapiens
ctcattctcatgtattgcactaatatatcactggaatgacaactgcttctgatgatctattaatgcaatacatcagggtgag

SEQ ID NO: 484 - DNA, 82 bp, Homo sapiens
gcttttttggaggcctttcaaactgccttaaggggttttaaagtgatatctggggcagctgctgaaagccttcagtgtttgc

SEQ ID NO: 485 - DNA, 71 bp, Homo sapiens
cacatttattattgcccacaggaaagttcatgcttaatgtatgcaatgaattatgggtagcaataaatgtg

SEQ ID NO: 486 - DNA, 75 bp, Homo sapiens
tccacagctccataaatgtttaatgccaccggctgggcaggaatgaggcaggtgctgaaacagggagactgggga

SEQ ID NO: 487 - DNA, 74 bp, Homo sapiens
ctgaaaaagatccaaaagaggcttccaagagagcattaagactgctgctctattgatagttttgggaatttcag

SEQ ID NO: 488 - DNA, 75 bp, Homo sapiens
taactggttttgtgtcaggaagatctttctcgccgctacccagcctggcgtgacggattaaacatcaactagtta

SEQ ID NO: 489 - DNA, 76 bp, Homo sapiens
agcccaggttcacatggttaccacattatttggctaaagctattaatctctgtggtcaggcctgtaaagctggtct

SEQ ID NO: 490 - DNA, 86 bp, Homo sapiens
tctcttgacatttcaaagatgccattgaccaaacattttatgaaagtgttatttcaaactgacatctttgtgctatcttcaaggga

SEQ ID NO: 491 - DNA, 73 bp, Homo sapiens
gaaattattttgcttctatttatagcctctgtcaaaagtcaaaagactataaatgctttgcaaaaatggtttc

SEQ ID NO: 492 - DNA, 79 bp, Homo sapiens
tctttattttgatgatatatttttgtaaggaaaatattcagatgatcaggaatgtatataactgaaatcaagaaaaaga

SEQ ID NO: 493 - DNA, 71 bp, Homo sapiens
tcccacttgctggcagtatatcatggcacagtttcaacagaattctactatgagctgtgagctaactggga

SEQ ID NO: 494 - DNA, 77 bp, Homo sapiens
cttgttagacaatcacagctgggggccaggggtaaatttagcctttgttcagcccccagttatgtgtgggatgcagg

SEQ ID NO: 495 - DNA, 78 bp, Homo sapiens
atccaccggtggtgaagcacccagaaagcaagtggctacaaaagccgcctgcaagagtgcgcccactactggaaggat

SEQ ID NO: 496 - DNA, 77 bp, Homo sapiens
tcagctaccgtgcttgcacagggctggaatgtccttggtataacaagacatgcaataatgtgcactcatgtagttga

SEQ ID NO: 497 - DNA, 71 bp, Homo sapiens
tcccattttcatcttgatggagatgataaactcttagaaaacttttatggctcccaggatgaaactgagga

SEQ ID NO: 498 - DNA, 86 bp, Homo sapiens
gcgccccgcgcttgacctcctcgtaagcgcctacctgctcccaggtggccaggaaggcgtgggtgggggtaaagcgcgcagagcgc

SEQ ID NO: 499 - DNA, 76 bp, Homo sapiens
gttagaggtaaacactgtctctggtattgaagaggtgaatatgtttacaaaccaaggaacagtgatccactttaac

SEQ ID NO: 500 - DNA, 81 bp, Homo sapiens
atgctgtttgaagggtctctgttttctctcttaatttgggtcattacttagaaagcaagcgtgagatcatttcatcagcgt

SEQ ID NO: 501 - DNA, 87 bp, Homo sapiens
gatagcctttgttaaaaagtttaatgttcttaattagttgaatcggttgggctaattagaataccaattagaactggcagggctatc

SEQ ID NO: 502 - DNA, 87 bp, Homo sapiens
gattgtagccggcgacagttctgtgtgaacaccctgggatccttctactgtgtcaaccacacagtgctctgtgccgatggctatatc

SEQ ID NO: 503 - DNA, 77 bp, Homo sapiens
ccccattttcagaagatgccatggtttattaattctctgcagaagcaataagaactgggtattggcttaatttgggg

SEQ ID NO: 504 - DNA, 90 bp, Homo sapiens
gagaaacctccaaagctgggaaactaaaagtgaaggctagcacttaattcctcactttttctgcttattcctatgtgttggagggatctc

SEQ ID NO: 505 - DNA, 79 bp, Homo sapiens
gatgactgtgttaagtgcatctgtattgtaagtgaaatgtaattatttctgtgtaccatatggagtaactaaggtcatt

SEQ ID NO: 506 - DNA, 86 bp, Homo sapiens
ctctcaaaattcatgtaatgcagctgttggcaaccaaatacccagcttcttgccaaaaactgcagattaaacattcgttatgggag

SEQ ID NO: 507 - DNA, 85 bp, Homo sapiens
ttggggaatttggtgggttttcagaagttagcccttctggtgtagggtttgttgatttcgatacaccagattatactcgtcccaa

SEQ ID NO: 508 - DNA, 78 bp, Homo sapiens
agggaggcagagcagagactgtgattcacatgttttatttatttgttcagagtcacggccatcctattgtgtgtccct

SEQ ID NO: 509 - DNA, 76 bp, Homo sapiens
catcaggtcgaatcagggtgttgaccttggccacatcaatgtcatagagcttcttcacagcctgtttgatctggtg

SEQ ID NO: 510 - DNA, 90 bp, Homo sapiens
tgtgattaatcccagggcatttggtatgaaccaaagtgcattccttttatatgtgcctggctctagtaaggatggccagggatttttaca

SEQ ID NO: 511 - DNA, 73 bp, Homo sapiens
ttttagctacagccccgtgtcagggttgcacggggaatctcgcagcagcccctgccaggaactggagctgaga

SEQ ID NO: 512 - DNA, 81 bp, Homo sapiens
gaccacttgttcaaggttactttacccaccctcctttgtgatccagagccaaaggatccaaatgggtaattacctttggtc

SEQ ID NO: 513 - DNA, 87 bp, Homo sapiens
gccaaattaatttagctttaaatagcagcactgagaatgtttccacaaaattttctccgaggagagctaagcagaattaatgatggc

SEQ ID NO: 514 - DNA, 73 bp, Homo sapiens
agtaccaccaaacaatttgcatttccttagggagtaattttcctacaggacaaatagcagttgtcaaaggact

SEQ ID NO: 515 - DNA, 76 bp, Homo sapiens
cacttggtttgggagtacataacattttttaattaaatttgtgttattattgtacttacactcaaagggccaggtg

SEQ ID NO: 516 - DNA, 69 bp, Homo sapiens
gtcttgctgagtgtctttctgggagataccacttgtggctcttgtttacccaaagatcactttgaagat

SEQ ID NO: 517 - DNA, 85 bp, Homo sapiens
ggagccagcagagggagctgtcgtcccagaactttcttagagctgctaagaaattctgattttgaaaaagatcttcctaggctcc

SEQ ID NO: 518 - DNA, 76 bp, Homo sapiens
gtgtttgcgcagtcaagtaccgtagatttaacagaataatcgttactgcccttgtctttatttgacccgcagacac

SEQ ID NO: 519 - DNA, 90 bp, Homo sapiens
gatgaggtaggtgggtcagagtctggccaggtgaaaggaggcaccccagtccttggacctgactctgcttcctggacaccttcctcagtc

SEQ ID NO: 520 - DNA, 68 bp, Homo sapiens
gggcgctccagtctcgacgttcccggggtagagagcaacgtccggggacgaacgggacgggtgcgccc

SEQ ID NO: 521 - DNA, 78 bp, Homo sapiens
ctttctgtttgtttgcactttgaattgctctagcacacaaaactgttagataaaattccatctgtggttaatggaaag

SEQ ID NO: 522 - DNA, 90 bp, Homo sapiens
atgcctgccaagggagttgagagatgtcattgtgctttctaagcacacttgaactgacttttgataacctttacctaccaaatcaggcat

SEQ ID NO: 523 - DNA, 89 bp, Homo sapiens
ggctttctgaagtgttctgaatgatggctgtgattgaaaggcccagtttcaaataagacaagaccatctttggagctccacaggatgcc

SEQ ID NO: 524 - DNA, 80 bp, Homo sapiens
gcaggcctgaatattaatgaagccatctagtgatagagttgcttcctgatgaaggaacatatcaaagaggttaggtctgt

SEQ ID NO: 525 - DNA, 74 bp, Homo sapiens
ggtgtgcagcagaagtacgcgtacaaggagcggcgggccaagctgtacgtgtgtgaggagtgcggctgcacatc

SEQ ID NO: 526 - DNA, 83 bp, Homo sapiens
tgtaaatctgttgcccaatcttaacatttttgagctgcatttaagtagactttggaccgttaagctgggcaaaggaaatgaca

SEQ ID NO: 527 - DNA, 87 bp, Homo sapiens
aatctgtagtcataagcagtgtgggtgaaatacaaagtgtatatttagactttagtgttgctcatacatatgcattgtttttagatt

SEQ ID NO: 528 - DNA, 73 bp, Homo sapiens
ggattggccgagcaagcctggaaaatggtaaatgatcatttggatcaattacaggcttttagctggcttgtct

SEQ ID NO: 529 - DNA, 85 bp, Homo sapiens
ttatttccatgtgtattctttttaaaactaagactaccttgatcatggttttgattacaaatcccgaaaacaattatggaaatga

SEQ ID NO: 530 - DNA, 90 bp, Homo sapiens
aggttgcataaatggtgacaaaatttacatctttgtattcaagaagagtatagagttacttggtgaagatcactacatatgttaaatcct

SEQ ID NO: 531 - DNA, 70 bp, Homo sapiens
gattcctgctcccagagccataaagtgggagcccccatttattaattgggctgggactggggcgggggtc

SEQ ID NO: 532 - DNA, 86 bp, Homo sapiens
gacagaactttattctggtatagaaagtattaaaagttgttttttcagcaatgactgttttctttctgctgttagaataaaatgtc

SEQ ID NO: 533 - DNA, 74 bp, Homo sapiens
taggttccctcctcctctccctgctctgcccagcaacagcagaaaggaggttttaggaggagaaggaggcccta

SEQ ID NO: 534 - DNA, 73 bp, Homo sapiens
ggcgtttcttcttgtgtttcctcttctccttttctggagagggatgaaggagaccctttgcaagaggcatgtt

SEQ ID NO: 535 - DNA, 81 bp, Homo sapiens
gagacactcatgatgactcaatggagaatcaggcgacctgggcatttaactatgcgcctattcccaatgatattctgtctc

SEQ ID NO: 536 - DNA, 83 bp, Homo sapiens
ggcagaatacagctacattttctccagccatttccccaacacatcctggagaaggcttgattttgtggcctctttgtactgct

SEQ ID NO: 537 - DNA, 72 bp, Homo sapiens
ggtaaaaatatgtgtctattttatagtaaatgctttactgtaagcagatattaaaagatgacattgttgatc

SEQ ID NO: 538 - DNA, 88 bp, Homo sapiens
gcctttctatttcagatgaaggataaaatacttggtagaataactttcattgttcccattcccaaatccttttctgtgtgtggagagc

SEQ ID NO: 539 - DNA, 86 bp, Homo sapiens
acttatttgacaatgttacgaggattcaagctggaggcaaacatttgacactccagccatggaatgctgtaaaaatttaattaggt

SEQ ID NO: 540 - DNA, 82 bp, Homo sapiens
gatgtcaatgagaataattgctttttaaattgggaacctaattctttccaacatatcataaccaatttttctccatgacgtt

SEQ ID NO: 541 - DNA, 74 bp, Homo sapiens
cagtttgtactggggggtcaaaggggagttcttttccgaagaattctgggagagacgccaactagagcaagctg

SEQ ID NO: 542 - DNA, 88 bp, Homo sapiens
ccaatgcctctcacctcctcacttgtggcaccttcgcttttgatccgaagtgcggggttattgtgagtgacggtgtgggaggagaggg

SEQ ID NO: 543 - DNA, 83 bp, Homo sapiens
gacttatacttgttctgcttattgattacttaattagttttctaagatagctaatcagagagagatgtaggtatttaggagtc

SEQ ID NO: 544 - DNA, 79 bp, Homo sapiens
tttgagtaaatagaactgttctttttagcagtatgtgcttaagaagctaattataattatacagatctatttatataaa

SEQ ID NO: 545 - DNA, 90 bp, Homo sapiens
taatttcattcaaagtaccccattggtaatgcttttgttctctgttccaacaaatcaaattactgtgggacagatttgatttggaaattg

SEQ ID NO: 546 - DNA, 89 bp, Homo sapiens
gtcactgaagtggttaaagctttgtttgtttgttttgttctgaatggctcttaatggattaagctttaggctttcaccaaagcagtaac

SEQ ID NO: 547 - DNA, 82 bp, Homo sapiens
tctatttaggctgcagctgttgctattatgttaataatattttttattaccactgtatacaacaggttatggcaataataga

SEQ ID NO: 548 - DNA, 80 bp, Homo sapiens
agcaacttcctgcagctctggtctgttgctaagcagtgaccctactgctaccatggcaacatcagagactccggagtgct

SEQ ID NO: 549 - DNA, 70 bp, Homo sapiens
cttcttggtgagctcctggcgcagcaggtggtagaggcggacgctgcgctgggacgccaccaacaggaag

SEQ ID NO: 550 - DNA, 72 bp, Homo sapiens
tagatcaggagcttaggggctttccctggtttttgctgataccaggctaaataactgctaatgccctgactg

SEQ ID NO: 551 - DNA, 77 bp, Homo sapiens
ctgtgaaatgtgcacatttcaaagcaaatggctccaggagctcataattgctgccaaacgtgtgtggattttaatag

SEQ ID NO: 552 - DNA, 89 bp, Homo sapiens
ggatctcaagcaaagtgttcagaacagtctctggcagagcccacaccaaaggcctgttgcagaccttcttaacaaatagcttgacactc

SEQ ID NO: 553 - DNA, 74 bp, Homo sapiens
gctcagcgagctggagccgcctgcccccgagagccccatggctttgctggctgacccagctccagctgctgagt

SEQ ID NO: 554 - DNA, 73 bp, Homo sapiens
atttgtgggtaaacatcatttgtcactcataataagaaagtgggaagaggagaatgttaacatacctatagat

SEQ ID NO: 555 - DNA, 86 bp, Homo sapiens
atgaatagtattttcttaagcacttttaagttgtcattcacagcctattttaaaaatgacttaatgagtaaaaatatgctgtttat

SEQ ID NO: 556 - DNA, 73 bp, Homo sapiens
cgtgttttcttgtctctgattgtaaacagatttgactaaagaggtaaattagaagttaattagagagaacatg

SEQ ID NO: 557 - DNA, 77 bp, Homo sapiens
aaatcattaaagcataagtctggacctgtagagggtttctttcaatattttataggaaggattttgatctatgattt

SEQ ID NO: 558 - DNA, 90 bp, Homo sapiens
gtggatattgttgccatcagtgaccccttcactggcctcaactacatggtctacgtgttccagtgtggttctacccatggcaaattccat

SEQ ID NO: 559 - DNA, 84 bp, Homo sapiens
gattttgttgggattactgctgccaatcaagttcaagtgcatttttaagagcttaatttgtggccctaggtttcgaataaaatc

SEQ ID NO: 560 - DNA, 83 bp, Homo sapiens
cagtactgacattttttgctctaatctttgtttatagaaggagtaaataatcgaaacaaagaacattccagtatgcagtgctg

SEQ ID NO: 561 - DNA, 75 bp, Homo sapiens
gtcacttcagaagacatttaggtggacttggtaccacaccagagctctttaatctgtgacttctgagaaagtgac

SEQ ID NO: 562 - DNA, 80 bp, Homo sapiens
gtctttgctgatatagaggaaggaaggggaaaaatgagcgcattagttctcttttattaaaagagttatttcagcatgac

SEQ ID NO: 563 - DNA, 77 bp, Homo sapiens
gtctagccttgttcatggtaattatttctatccattatccatcatgctaagaaatgacagctcagggacaaggagac

SEQ ID NO: 564 - DNA, 73 bp, Homo sapiens
gcttgtttgtctaaatacattttatttggaattcagtatgaattttcaatagatgcttttcagataagaaagc

SEQ ID NO: 565 - DNA, 73 bp, Homo sapiens
tggggttggatccccatggggcagcttttggaccaccagtgttaacccaggaattggagcgatctaaacccta

SEQ ID NO: 566 - DNA, 77 bp, Homo sapiens
gtgtgttcagttatatacactgaattgaacctttggcactaggaatcacagcattttgtcatatagcatgaacacat

SEQ ID NO: 567 - DNA, 81 bp, Homo sapiens
agcatgaccattatgtactacagcctacaaaattattcttcatgctcccacagcagagctagtgcaccatatggccatgct

SEQ ID NO: 568 - DNA, 74 bp, Homo sapiens
tgcagtgtcaacttaatcaatggttcatcactgtactttttcagtgcttgaatcttattaggattgatgctgca

SEQ ID NO: 569 - DNA, 88 bp, Homo sapiens
ctggctcctccatctgcagcagcttttggcaaagagaagtttccctttctggctctgcctcttggctgcaccagaaccttcttgccag

SEQ ID NO: 570 - DNA, 78 bp, Homo sapiens
tgttaattggaatgttggttttcagttgcagatgccaaatcttcataaaagtaattggatttagcttcctatttagca

SEQ ID NO: 571 - DNA, 87 bp, Homo sapiens
ggagttagagaggcatttttattgattaaacaatcgaggcgatttgtctttacaaaactgaaaatatagaggtgtctctttctctct

SEQ ID NO: 572 - DNA, 70 bp, Homo sapiens
ctcctattcccagtcatctggaagcaattcttcacataattgatgaacttgccttccactttgggaagag

SEQ ID NO: 573 - DNA, 85 bp, Homo sapiens
attcacaaagttggagcactataatagagattttcaataatatatgttaaaagggtttttatgtgatgtcttgcaacttgtgaat

SEQ ID NO: 574 - DNA, 89 bp, Homo sapiens
ggcctccttcaattccaagctgaacaaatgactcatgaattctaatccattcttctagtctcagcttccctccttcatgctgggaggcc

SEQ ID NO: 575 - DNA, 77 bp, Homo sapiens
gtcagcacttacattaagaaatcggctacaaccctgacacagtagcgtttgtgccaatttctggttggaatgttgac

SEQ ID NO: 576 - DNA, 84 bp, Homo sapiens
tctgcgctcactttccacctccacagctgctgccacagctggtcactgacggaatgtgcagctgctgggagccacatgtgcaga

SEQ ID NO: 577 - DNA, 72 bp, Homo sapiens
taatagaatttgttttgaaatatacactggcaatattgaaatatactcagtgcaatatctgcagttctattg

SEQ ID NO: 578 - DNA, 90 bp, Homo sapiens
catgaaaaagtaagtaaaatatgccatgtattatgggtatgcaccaagtcaactataatacagtatatctgatatatactgactgtcatg

SEQ ID NO: 579 - DNA, 74 bp, Homo sapiens
cacaggttgtgtggtaataaaagacccccgaacaaaatgttccaggggctttggttttgtgacctactcttgtg

SEQ ID NO: 580 - DNA, 77 bp, Homo sapiens
tataatttacagctttgatatttaatatttaataacccagatcttagaagaatactagatatagctgtgtcattatg

SEQ ID NO: 581 - DNA, 88 bp, Homo sapiens
gccatccttgcaataaacatattatggaagtttataaacttggcctatctctttggctgctttaggcttctggtgtgcctgggatggc

SEQ ID NO: 582 - DNA, 87 bp, Homo sapiens
ttgccctcgggttataaatgttattgcatttgtgtagcactttactgctgccctcagcttgcaagcatcacaggatcccagtggcag

SEQ ID NO: 583 - DNA, 81 bp, Homo sapiens
gaattcccatgatgccaattaacctaacttattccaaaacaattctctgtttggaaagaataattttcattgtgggtgttc

SEQ ID NO: 584 - DNA, 89 bp, Homo sapiens
agctatcagagcctggaatggcatccgtttggtataattgtatctcactgatgccagccccaagagttctaattaatatatatttagct

SEQ ID NO: 585 - DNA, 79 bp, Homo sapiens
ttatttctatttgtacctgagcctatatttatggataatctattgaaggaggaaatatggctcaggtgagtgggaatga

SEQ ID NO: 586 - DNA, 88 bp, Homo sapiens
tggtgttttctgttggtgtttctttgaacaatgtttgtccttcactttgacagtcagctgtacaaaggtattactgtcagataaccca

SEQ ID NO: 587 - DNA, 78 bp, Homo sapiens
agtgttttagggccttgatttatgcaacaagtttagtttaataaagagcaaaactgctaatcagtgcccacagatatt

SEQ ID NO: 588 - DNA, 88 bp, Homo sapiens
cgtttgccatcagtaggcctgtcagagtcaatgcttcagtttcataactgtaattggattgtctgacttcctattcaattggtacatg

SEQ ID NO: 589 - DNA, 72 bp, Homo sapiens
ggacccctagaaagggccagagctggggtcagaggccacctcctccattctctgccctgctctgctgggtcc

SEQ ID NO: 590 - DNA, 74 bp, Homo sapiens
gttttgatcatgtcggtatatttatatgtaaatacaaaactgtatcactgtaagatattgaatatgaacattac

SEQ ID NO: 591 - DNA, 89 bp, Homo sapiens
ggatatggagttgtagtagaaaaagcacctgcttttcagaaagactattgtttcctaaccatgagaagcagactataatattcatattt

SEQ ID NO: 592 - DNA, 87 bp, Homo sapiens
agagcctgaggagccattttaagcaatggggaacactcacagactgtggtaatgagagatccaagcaccaagtgctcctggggcttt

SEQ ID NO: 593 - DNA, 88 bp, Homo sapiens
ctgaacaaatagcagatgttgatgaatattaatttgtgcttagattaatgcttcaaagtgtcaatttaatttctgttttactattcag

SEQ ID NO: 594 - DNA, 83 bp, Homo sapiens
gagcgtgaccttttaaaactccagtgtgaatatctcatttacctaatgactttatgtcacctaggaagaaggtcaatttcctc

SEQ ID NO: 595 - DNA, 77 bp, Homo sapiens
ggagacaggacatagtcccagaggttgagctggcttatggagcccacaaaagactcagctgggctgaatccctctcc

SEQ ID NO: 596 - DNA, 82 bp, Homo sapiens
tgcatgttgaaaaataagcctttattgatcttaaacatctgtcagatgagtcatacattgggttattttttatatacatgta

SEQ ID NO: 597 - DNA, 85 bp, Homo sapiens
aaaatgctggaaaatgaaacttttcactctagataactatccaccctgtctggaaagaaaaatggttctctattttcaacatttt

SEQ ID NO: 598 - DNA, 78 bp, Homo sapiens
tgagaacatggactgagcttgtggtgtgctttgcaggaggacttgaagcagagttcaccagtgagctcaggtgtctca

SEQ ID NO: 599 - DNA, 79 bp, Homo sapiens
tggaaggagagcagcggcatttggtttggtggtgggcagattttcttttacgactgctaaatgcctgcctttctcccca

SEQ ID NO: 600 - DNA, 80 bp, Homo sapiens
tctccatctggggccctcagtgtgccaagttcttctcataagtggtcacagcagttaggttctttgctccagatgagaga

SEQ ID NO: 601 - DNA, 75 bp, Homo sapiens
tcatgctatcagggtacatgtatttagcatgttgatacagcatgttcattcattggtgtcctcatgtttgtatga

SEQ ID NO: 602 - DNA, 90 bp, Homo sapiens
gaaaataagctgcttctcttgagaataatgtcgtgagagtcactgaaagttcacgcaaatctcagagattgcccataaaagcttagtttc

SEQ ID NO: 603 - DNA, 81 bp, Homo sapiens
attgcagttaatgagccaccggcttgccgcttccagggccaggctggagcagtcagctggtggaatgatgggaactgcaat

SEQ ID NO: 604 - DNA, 81 bp, Homo sapiens
ctaaggaattaatggcccgctgaggttaatgagtccctcctctgggccatcaactctcccagctggccattaatcccctag

SEQ ID NO: 605 - DNA, 74 bp, Homo sapiens
gcacagtgatcactcactcaaattaacaaatcattttatttagaaatgaagagaatttgtaagtgacgcatggc

SEQ ID NO: 606 - DNA, 88 bp, Homo sapiens
tgtttccctgtggaaaagattactctaggcaaattttagaaaatgcttttaaaaagaatcttgtgtaagttgaaaacagagggaaaga

SEQ ID NO: 607 - DNA, 81 bp, Homo sapiens
gaggttcccaactgttttgagaaaatgtaaccaccagaccatctggggctgacattttcaacatggcagtcaggggagctc

SEQ ID NO: 608 - DNA, 88 bp, Homo sapiens
ggccctgagagcaatactcatattgattgcatttatttcactctagggaggagagataattcttcaatgtgggacacatctgggagcc

SEQ ID NO: 609 - DNA, 82 bp, Homo sapiens
ctctctctctcagttactcacaaaacatggctgtcttattcagagattagcaattattgtaatgagatactgtcggagaggg

SEQ ID NO: 610 - DNA, 87 bp, Homo sapiens
gcctcaggacttgagctaatcctggaaattctttaacttcccagaaagaaggttccacaagggcaggctgaggtcctcagagagagc

SEQ ID NO: 611 - DNA, 89 bp, Homo sapiens
tattgatgaagctgtaattggctccctctctcagagcctgggtgtctgcaggcccaggcgctggggctaattgttgcaggcaattaata

SEQ ID NO: 612 - DNA, 77 bp, Homo sapiens
agtctgtttaaaatggcctagaaagcaaagcacatgctttaatctgatgtctaggctgcattttaaaaaattggatt

SEQ ID NO: 613 - DNA, 79 bp, Homo sapiens
gtgtacgttcttgtttttcctagtagcagatggtgctgaaagaagatcatctctgtggggccattacaggataatgcac

SEQ ID NO: 614 - DNA, 89 bp, Homo sapiens
gggatttgctgatttgtctgtgttgaaataaattccttgttctgttctaattgaatagattgaacacagactgtatttgttcttatcct

SEQ ID NO: 615 - DNA, 78 bp, Homo sapiens
tttatcctttgtggacttggaggaattattagctgtggcacaacacatacagcattggttcctctagatctggttaaa

SEQ ID NO: 616 - DNA, 85 bp, Homo sapiens
gatgcacaatgatccatagtccatgatttataccagcccatgtatactaacggctgatgtctccatggtacttctcattagcatc

SEQ ID NO: 617 - DNA, 88 bp, Homo sapiens
gcaaacctgcttatttatttcatgacaagggaaacaactttcagttctgtgggacttgacacctttgtcaataaaatctgcagattgc

SEQ ID NO: 618 - DNA, 84 bp, Homo sapiens
aggcacatgtggtagtatttaccccccaagaaatggacacagattcgtgtcttgttcagtaactctagcaccttagatgtgcct

SEQ ID NO: 619 - DNA, 89 bp, Homo sapiens
acctgctttaaattgcatctccctgtagccagaggctcaatagttggttaaattcaatttgagttgccacaggctgttaatgagtaggt

SEQ ID NO: 620 - DNA, 72 bp, Homo sapiens
catttatcagtcgaagcaagtaattccatgttctgtgaatggcagaatgagaccaggttcgactgatttatg

SEQ ID NO: 621 - DNA, 81 bp, Homo sapiens
cagccactttctaagaatacagtgtagcttttaggcaatctgcctagaaattcttttccactgaattcctggaagaggctg

SEQ ID NO: 622 - DNA, 85 bp, Homo sapiens
gtagctgctgctctgttagctatactgacttggagcttggctgtaggatcaagtttggggtgggtaactagtgggaggcagctgc

SEQ ID NO: 623 - DNA, 76 bp, Homo sapiens
ggtctttgtggagcgtgacattctcacctttgccgagaacccctttgtggtcagcatgttctgctcctttgagacc

SEQ ID NO: 624 - DNA, 76 bp, Homo sapiens
ccatctccccctgtcaatgagtaatttatctccagcagcaatatgcataagttgtctttgaaaaggtgggacatgg

SEQ ID NO: 625 - DNA, 71 bp, Homo sapiens
catcttttctcttggctgcttccccagaattccccgcagggaaccatcttaagcaggcagaaggatggatg

SEQ ID NO: 626 - DNA, 87 bp, Homo sapiens
tattccgtgggcacatgccatatgttttgaaggaagatgataagtactgttttgtcactttttcttggcaaaatgcaaaatggagtg

SEQ ID NO: 627 - DNA, 78 bp, Homo sapiens
ataaatcagaggcagaatcttttaacatttacagttttaagtgaaattcctgttgagagtctcttaagctagatttat

SEQ ID NO: 628 - DNA, 89 bp, Homo sapiens
accttgaaaggaaatctgtaaattctgacattaacatacagaaaatcaatttgataaatgtaggatttggagttactttattttagggt

SEQ ID NO: 629 - DNA, 88 bp, Homo sapiens
tagttttagattatgatctattgattatctgcttttatttgtgttttaaatgaataaacaaaaagaaatcatcatggtttagtaatta

SEQ ID NO: 630 - DNA, 76 bp, Homo sapiens
tagattttagaaacatgcaaatgaagcacactgttttccatggttgtttgattttcatttgggtgttttgaattta

SEQ ID NO: 631 - DNA, 89 bp, Homo sapiens
gctgaggtaggtgggtcagagtctggccaggtgagaggaggcaccccagtgcttggccctgactctgccccctggacaccttcttcagt

SEQ ID NO: 632 - DNA, 73 bp, Homo sapiens
tagcaattatgtcatttatgcttacactaattaagtgttgatgtgtgagcagtaagttgcaatgatgtcgtta

SEQ ID NO: 633 - DNA, 86 bp, Homo sapiens
aagatagaggtcatttctatgcagagaaaaacaaatgagctgtgtcattgcagaaatgttctgcatggtttgctgccatctgtctt

SEQ ID NO: 634 - DNA, 75 bp, Homo sapiens
cccagaaatttttatctgctattaatctttcaggatatagttagtgttgtgatatattcagatattgtttttggg

SEQ ID NO: 635 - DNA, 75 bp, Homo sapiens
cacctccaggtcagcgttggcctcctccagggcacgcaccttgtccaggtaggagaccaggctgtcgttgaggtg

SEQ ID NO: 636 - DNA, 76 bp, Homo sapiens
aatgagtttaattgaagcatttggttatggggtgaacgcaaatcaaatattgtgagatgtttcaattatagttatt

SEQ ID NO: 637 - DNA, 75 bp, Homo sapiens
aaagaagggtgtgtgacagtttaatagtgttttgttaaaaatagaacgtgttttaagagtgtctggactttcttt

SEQ ID NO: 638 - DNA, 83 bp, Homo sapiens
gcctccccttccaggtcattacctgcggccgcggaggcaacagctgccaccatggcctgatgagtgatctggtgggcgacggc

SEQ ID NO: 639 - DNA, 79 bp, Homo sapiens
ttagctgcttaattaggcgaaacaaactttaagttgcatgccaggggcttaatttaatttgcctgggataagcagttgg

SEQ ID NO: 640 - DNA, 85 bp, Homo sapiens
agttgctataacaactttgatatttctttattatttttagcacttcagttgccataacaataagatatcctaaaaaatagcaatt

SEQ ID NO: 641 - DNA, 72 bp, Homo sapiens
tcctggaggggccattcacagtcttctgggtggcagtgatggcgtggactgtggtcatgagtccttccacga

SEQ ID NO: 642 - DNA, 82 bp, Homo sapiens
gaggagaaaagaaatgtagttacatattcatgagcttttaaatattcatgaggattgtaaagcagattaattttcatgcctc

SEQ ID NO: 643 - DNA, 78 bp, Homo sapiens
aaggtcatatatcttttgctgttctctgttgcatgaagtagcctttatgcttcagaaaatttaaaggtcattttcctt

SEQ ID NO: 644 - DNA, 78 bp, Homo sapiens
ggctctcaattgctagcaggtttctctcattgcacctcatttgcatctgggacatcaattagcatgtttgttgaggct

SEQ ID NO: 645 - DNA, 71 bp, Homo sapiens
aagtggctctgaggcatcatggagaacagttgaaaatcacattgtcagctcgaaatgcatcaaagctattt

SEQ ID NO: 646 - DNA, 84 bp, Homo sapiens
aacccagaatattcattttttaatcattgctcagtgttgcaaaaaagacttagttttaaaataaatattccatttcactgggtt

SEQ ID NO: 647 - DNA, 80 bp, Homo sapiens
agagggtgtgctctggggagggcccacccaagacagacctcatggccttcagtcccagccttcctcagggtccatcctct

SEQ ID NO: 648 - DNA, 72 bp, Homo sapiens
cacttttgactctggtattgatctttctccaggttgtgaaactcagagggcaaagtgcaaagttcaaaagtg

SEQ ID NO: 649 - DNA, 77 bp, Homo sapiens
agacagcggccgcgtcagcttcctgggcctggacctggatgcgcagcaggcccgcgtgggccagtggctgctgctct

SEQ ID NO: 650 - DNA, 88 bp, Homo sapiens
attcagtgtgtttatctgaatctgagatcatgccgtacatgtttatttgaatgtgtgatgtgcaatcaatcaaataaatgcactgagt

SEQ ID NO: 651 - DNA, 83 bp, Homo sapiens
ttccagccaggccacctctcctttatctgcagtgtctattttaagactgcttcactgcaaggagtatggggcccgggcaggaa

SEQ ID NO: 652 - DNA, 77 bp, Homo sapiens
tagctgcgctggcgcaatgataccttaatgatagattttccgttcttatttttagctctcattcgcctacacagtta

SEQ ID NO: 653 - DNA, 74 bp, Homo sapiens
ccccaccaaccaccagtgctcaggacttctgcaaatcccattcggatctgggagcagctgatgagggggtgggg

SEQ ID NO: 654 - DNA, 83 bp, Homo sapiens
aggccaaacatgaaacgcttctttctcagaaattcagagaagagactctgagaaagatcttccctttgcttttctgatggctt

SEQ ID NO: 655 - DNA, 79 bp, Homo sapiens
ttgtcttcacttgacaccttatagcactccagagagctctttggaagaaagatgttttaaatgtcaggtgttaagataa

SEQ ID NO: 656 - DNA, 78 bp, Homo sapiens
tgattggttgtcaccatcataatgatagctttgaccttcttcctcttcaaatgtcgttagtctgtgaccaagcagtca

SEQ ID NO: 657 - DNA, 77 bp, Homo sapiens
atttctcttaatcatagcatcattttgatccttcattggatacctctttaaaatgacacacagtgcagaggagaaat

SEQ ID NO: 658 - DNA, 73 bp, Homo sapiens
aaatctttgaaagtatgaggatatattcttacataaagtgaagtgagtcctttaaaatcattttctttgattt

SEQ ID NO: 659 - DNA, 74 bp, Homo sapiens
gagccctgcagcccaaactgagatgtgatttttatggtaacaagatgatgacaaactgcagagggatagggctt

SEQ ID NO: 660 - DNA, 83 bp, Homo sapiens
ttgcatgcagaagagaagctgcacttagatggatgattaatagtcctgttgttggtaatctattgtatcttttttgcatggaa

SEQ ID NO: 661 - DNA, 78 bp, Homo sapiens
agcacacagctcttcctaaaattgaaggtggtttatgcccaagatgaaactgaattctatttgggcaagagatgtgct

SEQ ID NO: 662 - DNA, 87 bp, Homo sapiens
gggtcatgtgtttgtcaagaggccacttagagaaatcatttccatgtaatttttaatacagttctttggatagactttttatgactc

SEQ ID NO: 663 - DNA, 81 bp, Homo sapiens
attttctctactctttccaatggcttctccaggatgctgaatctaaaaggagaatcaaccaatgagccagtaagagaaggt

SEQ ID NO: 664 - DNA, 74 bp, Homo sapiens
ctcccacggcctgaagctgctgccaagctatttttggttctgcacagttaaaaatagcttcacggaggtgggag

SEQ ID NO: 665 - DNA, 86 bp, Homo sapiens
ggatttgtgatgcatttaatagccattagaagactagaatttgatttggtctaattacactattgaaaaaccatcaccatttatcc

SEQ ID NO: 666 - DNA, 74 bp, Homo sapiens
atgatgatttattttgggttgagtgctgacagtgtgctgagtgctgtaccagactcataagaagaaatggttat

SEQ ID NO: 667 - DNA, 76 bp, Homo sapiens
gatgttttattctaggaaataagaaacagatgacatcattgatgtatctttctttcatcttcagaatttttgcatc

SEQ ID NO: 668 - DNA, 81 bp, Homo sapiens
gttaaagcaaattggtatgtaattagatttatatactgaataatctcatttgcatatccaattaattcttcctgttttaat

SEQ ID NO: 669 - DNA, 79 bp, Homo sapiens
caggcacggaaagctgaaggtgctggagatgccacatgaagtgtgtgcatttttggtaactgtgtgcttctgatgactg

SEQ ID NO: 670 - DNA, 83 bp, Homo sapiens
tacaaaattcagtcacatttcaaaattttctgctacaataattcactttatgtagaattaatgtgtctgattgaacgtttgtg

SEQ ID NO: 671 - DNA, 86 bp, Homo sapiens
tcccccaacccatccattaggccagcaacgcttgtagagctcactgtgggctgtaatgtggcactggtgggctgggacaccaggga

SEQ ID NO: 672 - DNA, 85 bp, Homo sapiens
ctcattgagggaagattgagcagaactggcattgcttgctttcgtcaaattgattgtgcccgtctgtttgatccaattcagtgag

SEQ ID NO: 673 - DNA, 85 bp, Homo sapiens
ccctgggggctgttctgctttttaatgaattcactttgatgacaactaaatgtggcaggtgtttcaggaagcagttcaaccaggg

SEQ ID NO: 674 - DNA, 87 bp, Homo sapiens
cagaaacgtcccacatgcccaccaggagcaagcttcaaaatgttcagcttgcttacattaagcagagtaattccagggatgtttctg

SEQ ID NO: 675 - DNA, 85 bp, Homo sapiens
caagtcctggagagggtctccaggagccagggagggagtgactaacttctgactgcctgggggcctgagagaaggctgggacttg

SEQ ID NO: 676 - DNA, 72 bp, Homo sapiens
ggttccagagtgcagattccagatttgttattttacagggctaataagtatgtaattatcacatttggagcc

SEQ ID NO: 677 - DNA, 76 bp, Homo sapiens
cagaacttttttggggaacttcaaaggtacactttagtaagcaaaaagagtttccaagtttcccattaatgttttg

SEQ ID NO: 678 - DNA, 69 bp, Homo sapiens
ggctttgcccttttcggtgacacaggctgttgctattccaagcagcctatcacaggcagggggagggcc

SEQ ID NO: 679 - DNA, 73 bp, Homo sapiens
gtggcagatgcataactaatcttagctgaatctatattaagaaatcagcaaggtgtctttatttaacttccat

SEQ ID NO: 680 - DNA, 86 bp, Homo sapiens
tctcgagaggggcaggcacggtgttccatggcaagacggcggttgatgtataggcgtggcatgaagctgggcttgctgctctcaga

SEQ ID NO: 681 - DNA, 82 bp, Homo sapiens
gagctgtatgcattgatatttaatgattgccatttttattccttttggagaattaaatattaaatatcaggcagaatacctc

SEQ ID NO: 682 - DNA, 89 bp, Homo sapiens
tcctgtggcccttcaaattatcttctgcattaagtggaatgaagaaaaaactacacattttgtagaaggtggagatggtggcaacaggg

SEQ ID NO: 683 - DNA, 85 bp, Homo sapiens
aatcacaccattcatgcatgtctggtatttttagctgcctttaattactaaccagctaaataagcatgcaaaccatgctgtgatt

SEQ ID NO: 684 - DNA, 73 bp, Homo sapiens
gaagggtgtgcgctgcagagcagtttcctgttatttggttaatggttgacctagttctaatgccatatgcttc

SEQ ID NO: 685 - DNA, 76 bp, Homo sapiens
acatttattaatatgcaaattctaagtggcaatctggacccagtcgggttgtgctaatttgcacattaatatctgt

SEQ ID NO: 686 - DNA, 82 bp, Homo sapiens
tcacatgtattaattgtactgctatctttggcttgcagaataggatgttataaagaatgcagtgaccattttggcatgttga

SEQ ID NO: 687 - DNA, 78 bp, Homo sapiens
gagggatccccaagggagaagaaagctatttggctgcttgactaattatatgcactaatagatttccattgggccctc

SEQ ID NO: 688 - DNA, 71 bp, Homo sapiens
gaacaaaggatttatatattttttgtacaaagttttttcttaaactgtataattttgtaaataatttgttt

SEQ ID NO: 689 - DNA, 76 bp, Homo sapiens
ctcccgcagtatgtgactgtgaaagggggtcacatgatagctgtgtcccctcaaaaacaggtcataactcctggag

SEQ ID NO: 690 - DNA, 89 bp, Homo sapiens
gtccagtgtgaggtgcagctggtggagtctgcgggaggccttggtacagcctggggggtcccttagactctcctgtgcagcctctggat

SEQ ID NO: 691 - DNA, 74 bp, Homo sapiens
tctttcacatttgagagcaatctggagcctctggaacatactgtggcaatccagtgcacttagcaactgaaaga

SEQ ID NO: 692 - DNA, 83 bp, Homo sapiens
taataccacaaagctaactcagtgacgcacatggccagctgataacagctgacacatgtgaatcgaaagccaagtgtgtatta

SEQ ID NO: 693 - DNA, 82 bp, Homo sapiens
tgttaaattgtggttgccaatttaaaataaactatggaatgctgactgtattttaaggttttgtagcctacagttttaaaca

SEQ ID NO: 694 - DNA, 78 bp, Homo sapiens
tctctagaacttttctttcttctatatttcaattataataagtcaattaaaatccataatgggaaaggagactagaga

SEQ ID NO: 695 - DNA, 82 bp, Homo sapiens
gcttccctaataatgttgaaccagttacaaatcattttattacacagtggcttaatgatgttgactgtttcttggggtaagt

SEQ ID NO: 696 - DNA, 73 bp, Homo sapiens
ttcagaatgaatttcatcattcttgttacaaatttgttttttgacactttaattatgaaggaactattctgaa

SEQ ID NO: 697 - DNA, 75 bp, Homo sapiens
caggaggtagggtttatgaggcaggccagctggttttgaagagccagatgctctcaaatacttccatgcctcttg

SEQ ID NO: 698 - DNA, 73 bp, Homo sapiens
agggattaaaagttcttcaagccagcggattcttggtttctaattgctaatgtttgaagtcagtttgattcct

SEQ ID NO: 699 - DNA, 73 bp, Homo sapiens
ggactccagcccactgccactgggtgacacagactgtcgtttgggcattatttcatggcagatgggccagtcc

SEQ ID NO: 700 - DNA, 82 bp, Homo sapiens
tcattgggttttatagtggctttctgatttctggtagtccattgaagaagggagtttgaaagttgttgtatactgttaatga

SEQ ID NO: 701 - DNA, 90 bp, Homo sapiens
gctcctcgtgctgtgtgaagaccaccggggccgcatggtgaagcaccagtgctgtcctggctgtggctacttctgcacagcggtaagagc

SEQ ID NO: 702 - DNA, 81 bp, Homo sapiens
ggtttgcattaactgtaatgaagcaaatgacaaaatcgataaagtgggaattgcgtggctgtcataaagatgatgtaaatc

SEQ ID NO: 703 - DNA, 72 bp, Homo sapiens
agtgttggagatgattccattaatcttgcgaagtgatcagtcactgggaggattgaattgcatttcctgcct

SEQ ID NO: 704 - DNA, 81 bp, Homo sapiens
gaaatgtcacatctgtctgcaattggctacctctccataggagaaacactgctggaagcctggagaccagatgttgctttc

SEQ ID NO: 705 - DNA, 72 bp, Homo sapiens
cctctgcctggctttctttgtaaagccattaaactacattaagaaggctactgctggagaaaggggaggagg

SEQ ID NO: 706 - DNA, 84 bp, Homo sapiens
caagggcacagtgagaagatattttattacccgtgtatttatttatgggttttgggggttttaaaactggcaattaaaaccttg

SEQ ID NO: 707 - DNA, 85 bp, Homo sapiens
gtttgggcacggagtccacaagggcttcagatggcagtttctggactgcagttcttgccacttgcaagctcttcacaccacaaac

SEQ ID NO: 708 - DNA, 84 bp, Homo sapiens
ctcttttccattatggtgtcagctaatttgggagctcattatttatttggcactaatttagcctggcaaattaattagaaaggg

SEQ ID NO: 709 - DNA, 74 bp, Homo sapiens
ctctcccagcccagcctgagtccttgtgtatcgtggaaatgggtgggactgagaagcaggatgagctgggtgag

SEQ ID NO: 710 - DNA, 77 bp, Homo sapiens
cccccacaggcttgaggccagaggaaacagcaactttcttcgctgggaaagtgttgtggggctcaagcatttggggg

SEQ ID NO: 711 - DNA, 70 bp, Homo sapiens
cctgtgttaccatagcatcccgtttccttggttaccggtggccaaggaaaggacactgggtaagtgcagg

SEQ ID NO: 712 - DNA, 89 bp, Homo sapiens
gccatttgccccaacttaggtttagaaattacaagtttcagtaatagctgaacctgttcaaaatgttaataaaggtttcgttgaatggt

SEQ ID NO: 713 - DNA, 71 bp, Homo sapiens
acaggctcatccctctgaacagatgagattagtcgatcatgtaaagtcaaaagggggattatgatgcttgt

SEQ ID NO: 714 - DNA, 84 bp, Homo sapiens
ggcaaccagctggtttttcacatagataaggtcaattaatttgacctttggttcaatatgaaatgcataataaaagctggtgcc

SEQ ID NO: 715 - DNA, 73 bp, Homo sapiens
gtactgctgcggtacctgctactaccgcttctgctgcaagaagcgccacgagaagctggaccagcgccagtgc

SEQ ID NO: 716 - DNA, 79 bp, Homo sapiens
gttggcggcacggtaggttcattagtcaataaagcattgccacgcgttttattgaattgtaaccctattttgccctgat

SEQ ID NO: 717 - DNA, 88 bp, Homo sapiens
gcagcatgcatgccatctgcgggggcattaatagccatgttattagccaccggtgtgaaagatgccctgcggatgggctatttgctgt

SEQ ID NO: 718 - DNA, 73 bp, Homo sapiens
aagaggaatagagaattcccacataaatagcagtttattcactgctatttaggaagcagttgtattttctctt

SEQ ID NO: 719 - DNA, 80 bp, Homo sapiens
tgctattgttttgaatatggctgtgagacaaagagctgcttaggtcaagcgctataaattacagttttcatacaatagta

SEQ ID NO: 720 - DNA, 73 bp, Homo sapiens
gcaatgtcttttgatagagtagtccctgccaaaagttttgctttgcatctggctacagatctaaatttattgc

SEQ ID NO: 721 - DNA, 88 bp, Homo sapiens
caagttctttcaattttggaggcccagcaccagggatgaattgagttatctctttctttcctgctgtgtgcttgtagtgaagagcttg

SEQ ID NO: 722 - DNA, 89 bp, Homo sapiens
taatggccttgtccttgggcacgcatcgggcacagttagtgcagcgaataggctgcacgtggccgcggccctttttggcacgaccattg

SEQ ID NO: 723 - DNA, 75 bp, Homo sapiens
gggggaaggggctggaatcatcgtgggttggaacagttaaaggaacctctgttcagccccagccccaaggctccc

SEQ ID NO: 724 - DNA, 86 bp, Homo sapiens
tgattaccaactcgtgtttattttaaatgtagttactcgccaattaaatagaaattagctacatttagagacagggttcctgatta

SEQ ID NO: 725 - DNA, 80 bp, Homo sapiens
gctgacagtgtcagtttgatacctggctttagggtctgagtgtatcctaaacctatcaggctggagttgttcactttagc

SEQ ID NO: 726 - DNA, 85 bp, Homo sapiens
taaacaagctctcaggagcaaatgattcatttctcatctactcagatgacatctggtttaagtgtgatgaatacatgcttgttta

SEQ ID NO: 727 - DNA, 80 bp, Homo sapiens
aacaacgatgtggaattaggtggctaattttatgcctatgcctatagcagaaatcagagttgtaaattcctcattgtgtt

SEQ ID NO: 728 - DNA, 75 bp, Homo sapiens
ctctctaccaccaaaataaattcaattactaactttgagtaattgcgggtaatttatttcttggagggcagagag

SEQ ID NO: 729 - DNA, 82 bp, Homo sapiens
gcaattatgtttcaacattaacacccattaagatgaatgacaatgcattataagtagtgtttcaatttgaaattgaaattgt

SEQ ID NO: 730 - DNA, 84 bp, Homo sapiens
gcattcatttagggtcctggcagctgagctgcacactgtgtcacccagacacttcagcagatcacaaagttaccctatgagtgt

SEQ ID NO: 731 - DNA, 73 bp, Homo sapiens
cttttctctcatcttgctttactaacagctattttgaaatcaaattagtttttacacctgtaaaagagaagag

SEQ ID NO: 732 - DNA, 86 bp, Homo sapiens
gatgtaattgcaaaatgaagctgcaaatgtcttacccagggaactaggtgacaacctgcttggcttcatgaagaaggaataatatc

SEQ ID NO: 733 - DNA, 86 bp, Homo sapiens 770
catggaaggcttccggagcttgaaggagggtgaggcagtggagttcacctttaagaagtcagccaagggtctggaatccatccgtg

SEQ ID NO: 734 - DNA, 72 bp, Homo sapiens
gatcccttgcaccaggctgggtggagaagttcattataattttagccatgaagtcctgaagtgcaggtaatc

SEQ ID NO: 735 - DNA, 77 bp, Homo sapiens
gaggtacagatttttacaaggacataatataagttattgttctgtagaaatatcctattaaatattgtatgtccctc

SEQ ID NO: 736 - DNA, 89 bp, Homo sapiens
gccatgggcctccatagtttcctgtagcccccttggttcccaagaatagttttggaatggggcgtgctgtgataatgggggttaatggt

SEQ ID NO: 737 - DNA, 78 bp, Homo sapiens
cattattcagttaatgagacggtaaactacaatttgcattgaaattgtccagtgttgcttttcattaaagagataatg

SEQ ID NO: 738 - DNA, 87 bp, Homo sapiens
ggccacttgggtgcattggacttgaacttcttttttgtctcccctttaggggggatatagattttcatttctctttcataacgggcc

SEQ ID NO: 739 - DNA, 85 bp, Homo sapiens
cataaaagatgaatcctggaaaaatctcgtcttttcattttctttgggacattgaataatgatactttcagttttcatatttatg

SEQ ID NO: 740 - DNA, 75 bp, Homo sapiens
tagtctgttttatgatttgatttcaggttttcattgttccaatgcaattttccagattgaatcttaaaaggatta

SEQ ID NO: 741 - DNA, 85 bp, Homo sapiens
gccctccctcccaccgcacttacacctgaacttgtctccagcactgcggacacccgggtgacacattctttcggagagggagggc

SEQ ID NO: 742 - DNA, 76 bp, Homo sapiens
aatcaaatttagctggaatgattcaataaaatgatggtatcattataaatgttgcactctttcttaaagtttgatt

SEQ ID NO: 743 - DNA, 84 bp, Homo sapiens
gacatcttcctggcgacaggaattgccagcagcaacggccttggcggttgccatggtgatacccttggtcattcggatgaagtc

SEQ ID NO: 744 - DNA, 78 bp, Homo sapiens
ggcttaatagtgcataaaatgtcaccacttcatttaacaaaatgggttctgaagttatgtaatcatgcattatgagtc

SEQ ID NO: 745 - DNA, 74 bp, Homo sapiens
ccatgacttcctgcatgctgttcacactgctgctctggctgcctgtgctcacggacatgcttggaatggaatgg

SEQ ID NO: 746 - DNA, 89 bp, Homo sapiens
ctccctgtgtatgagtacagattgccctttcttgcactgtatttagaaatctctgtattacccttgggcatttgttcattaataggggg

SEQ ID NO: 747 - DNA, 70 bp, Homo sapiens
ttaaaagttatttatgagctgttagggatcccataaggattacacctaattcagtctgtaaagcttttga

SEQ ID NO: 748 - DNA, 81 bp, Homo sapiens
tcagctgtctttagtttcacagtccagagaccatctgtctagacaggtgttatcgcactggtatctaaaagtagaaactga

SEQ ID NO: 749 - DNA, 89 bp, Homo sapiens
tcacttaactgtgaaaaagatatttgttggtggcgttaaagaagacactgaagaacatcacctaaaagattattttgaacagtaaggga

SEQ ID NO: 750 - DNA, 72 bp, Homo sapiens
aatgcacatggaaatgctattctattttggcttccagaagtagccctagtaaattctatgcaccaatgcatt

SEQ ID NO: 751 - DNA, 78 bp, Homo sapiens
gcaccactttctctcaccaattaaagtagaggagattaaagaattcccttgacacttggtccttgtgagggtggtagc

SEQ ID NO: 752 - DNA, 74 bp, Homo sapiens
cggcttgaaactggagccaattttctgtcttcatctcgcagtgttttgactggaggcagatccagttcaggccg

SEQ ID NO: 753 - DNA, 76 bp, Homo sapiens
cagcttttattgaaaatagttactgcagccaacgttggaaaagtttactgcagcttttgacttcttcaaagagctg

SEQ ID NO: 754 - DNA, 82 bp, Homo sapiens
taattgatatgacacacttactctacatgaacttggaaaaaagtctatggagtgagtgatttaattcattttatgttaatta

SEQ ID NO: 755 - DNA, 84 bp, Homo sapiens
ggcatggaatgttgcagcatccacaagaccaccttcaactccatcatgaagtgtgatgtggacatctgcaaagacttatatgcc

SEQ ID NO: 756 - DNA, 86 bp, Homo sapiens
gaagctctgcttgacacatttgcatttcaacttgtcaatttcagagtctcctctgtgaggggaaatgcagatgctccccagatttc

SEQ ID NO: 757 - DNA, 73 bp, Homo sapiens
atttgattaggggtgagcaggttggtaatgaaattacatttcagctctttctcagcccctgtaagtattaagt

SEQ ID NO: 758 - DNA, 71 bp, Homo sapiens
tctagggagataaagtgacagtgttgcttgttcaggctattgttcaaagaagcacgtcttttatttataga

SEQ ID NO: 759 - DNA, 75 bp, Homo sapiens
cttgcctgatgcttagctcatctgcaaatatgtgatcagtgccggtaatttgtaatgaatgaagcggtaggcagg

SEQ ID NO: 760 - DNA, 75 bp, Homo sapiens
tccatatgatgaatttgtgccattttcttcagtaaaagctattttcctgcacaaatggatgcattttatcctgga

SEQ ID NO: 761 - DNA, 76 bp, Homo sapiens
ttcatatgccaacctttgtaacactgatgggataataacattctttcaattttataatggtaataggtgtactgaa

SEQ ID NO: 762 - DNA, 82 bp, Homo sapiens
agtctcgatcaggggaaatgctgtcagcgtatcatctagatagattagaaaatgaacgctcaggtttctgtgaaggaagact

SEQ ID NO: 763 - DNA, 82 bp, Homo sapiens
tccagatttgcagaaaattaattctgtagatgatgtggaaacgatagcctataaagttaatgagatattactgaagtctgga

SEQ ID NO: 764 - DNA, 80 bp, Homo sapiens
gaaggaaaacaagaaattcaacttttaagctgggctattcatggcctttgctaaatcctggcagaatttcacagttcttc

SEQ ID NO: 765 - DNA, 84 bp, Homo sapiens
ccatcactgggtggccaaggcctggctgaatgacattggcctgtcccagtactcccaggcctttcagaaccacctggttgatgg

SEQ ID NO: 766 - DNA, 73 bp, Homo sapiens
attgggatgcagaacagtaattggaaagagagaaataaatccttctctttcagttgcttcactgattcccaat

SEQ ID NO: 767 - DNA, 70 bp, Homo sapiens
gttgaataacttttaattcattataatgcatatatgccaattatgcctgatttattaagagtagttcagc

SEQ ID NO: 768 - DNA, 85 bp, Homo sapiens
tcgggggtccattcatctattgcctttatgttgttttttaaaagaaaaaccatgatgcctttgtatttgctgtttgcacccctga

SEQ ID NO: 769 - DNA, 88 bp, Homo sapiens
gggccatgctctctgagccgccaggatattgtggcttttgctaattaaggagcggatgtgtcctgccagcgcaattagaggctggccc

SEQ ID NO: 770 - DNA, 75 bp, Homo sapiens
ctatgcgtcttgacggatttggggttggcagagcaggctgcccctgctttctatccccattcagtccacttatag

SEQ ID NO: 771 - DNA, 70 bp, Homo sapiens
aaacagaactttttaagataaactttaacttgctacaagtcataaaattatttccatataaagtctgttt

SEQ ID NO: 772 - DNA, 83 bp, Homo sapiens
tgctataattttcgtgtttggaaattcattaagaattcatttcgatgaatcccaaatgcatgcaccatgaaaaacaattagca

SEQ ID NO: 773 - DNA, 74 bp, Homo sapiens
gtaattcgatgttcacacagtgtaatgggccaaaggctaattactattcactgtaaaatgaacataaaagtcgc

SEQ ID NO: 774 - DNA, 84 bp, Homo sapiens
tgccatctgctctgaagcctcccaagctgggcctcccctcccacttctggagcccaggaacagatgtgggaggctgagcaggca

SEQ ID NO: 775 - DNA, 78 bp, Homo sapiens
ttgtatctctctaggcagtgtcagaatcattctcaatgaagataataatgttgaatccatctgccaagagaaggtcaa

SEQ ID NO: 776 - DNA, 71 bp, Homo sapiens
gctccagagtaactttcttgtgacatttggggttttaatggattccagaaacctgaaagtttctctgcagt

SEQ ID NO: 777 - DNA, 76 bp, Homo sapiens
caaccttgtttaaaatgcactgctaaagcatatattttcatgtattgctatgtctgaatgcatgataaccaggttg

SEQ ID NO: 778 - DNA, 73 bp, Homo sapiens
gaaattaagttctttacaccaagtaaatggttgtccacaaccactggctagtgtacatatgaactaaaatttc

SEQ ID NO: 779 - DNA, 77 bp, Homo sapiens
tctggccagcatggttttgattgtatgttgggttgtcagccagctacacaccagaactattattttaggcggctgga

SEQ ID NO: 780 - DNA, 78 bp, Homo sapiens
cctgcttgatttgcttaatggaagctgacagtgaagttcaaccctgattgtcagatttcagtaggaacctcaaggggg

SEQ ID NO: 781 - DNA, 81 bp, Homo sapiens
agcaggtgtgagctgacaagcagcaaggcgacaggatagaagtgtcgagaagttggcttgttatcagttagacagcctgtt

SEQ ID NO: 782 - DNA, 85 bp, Homo sapiens
gatgagttttaacttttgtattgattgggcagtgacatattttaaataatgattcacattaaaaatacaagggttcctattgatc

SEQ ID NO: 783 - DNA, 76 bp, Homo sapiens
tcacctttgatggccatgacttcgtggataagactgtcattcagaaataccacattgggaatggccacaactgtga

SEQ ID NO: 784 - DNA, 80 bp, Homo sapiens
cgactttatcacccatcggttatctgtgtcgcctgaaggaactccgggtaaggtacaggaaaaaggtgggggtattgttg

SEQ ID NO: 785 - DNA, 80 bp, Homo sapiens
tttctgtatatgtttctggagtcctgagcctgagctaaacaaaagcaggaggctgacggggctgctggagtttgcagaga

SEQ ID NO: 786 - DNA, 78 bp, Homo sapiens
ggtctctggggggttggaccagtcatctggctctgccttcctcagggcagagctggctgctggtgaggccaggaggcc

SEQ ID NO: 787 - DNA, 85 bp, Homo sapiens
ttggaggcagaagctctggcccctatggtggtggaagccagtactttgccaaaccacaaaaccaaggtggctggggtggttccag

SEQ ID NO: 788 - DNA, 80 bp, Homo sapiens
gtcacaggatcccaacgcagcaaggtaaaactatatatatgtgtgtatttgtctgggtctgagtttcggtttcttgtgac

SEQ ID NO: 789 - DNA, 70 bp, Homo sapiens
aggagctctttatttgaaagaagatggaaagaaatcctggaaaaggcgctattttcttttacgggcttct

SEQ ID NO: 790 - DNA, 85 bp, Homo sapiens
ggtgaagccctaaagactcaatctggtcttgatgaacatccaagaatctggatgtgagcatcccgctgaggtaggagcttctgcc

SEQ ID NO: 791 - DNA, 83 bp, Homo sapiens
gcaggatccctcttttcatctgaaaattaccactaatttgcaattagttggaggaaaattggagatggaggaaagggaattgc

SEQ ID NO: 792 - DNA, 80 bp, Homo sapiens
atgtcaaaatgtacatgtgacagctgtttgggactctaatgttatggaaaagcagctgttttcatttatatttgagatat

SEQ ID NO: 793 - DNA, 77 bp, Homo sapiens
gtcttttccattattcttttatgtcccacttgtattgcatagtctatggccaatccataaaagaataataaaaaggc

SEQ ID NO: 794 - DNA, 90 bp, Homo sapiens
ctcagagtctctgacagctgttagaagaagaatgtgattttgaaatttaaataacatgcttctgcattcggctcagggagacaacctgag

SEQ ID NO: 795 - DNA, 72 bp, Homo sapiens
gctgacccatttttgaaccttgagatggatgctggcatctccaacatccagcgaagtcagagctggctcagc

SEQ ID NO: 796 - DNA, 81 bp, Homo sapiens
atttgtctgtcagcagtggtcagctaaatgatcagctgacacagctcttcactccatgggtcactggcagaacagacaggt

SEQ ID NO: 797 - DNA, 70 bp, Homo sapiens
attgagtttatagacacagcggactcttgcctaatagacgagagtaatgtgtctaatgtcgaacatcaat

SEQ ID NO: 798 - DNA, 85 bp, Homo sapiens
gggagggaacttacgtgatcttcaggtgaaaggaggctttataaataggtcaccttgttccacatcctgaatttcattctttccc

SEQ ID NO: 799 - DNA, 84 bp, Homo sapiens
cctgtcaattcatgatggtgaaatagtgcagtggcttacagatggctacatagcgattataggccatcaccaacagaatgaagg

SEQ ID NO: 800 - DNA, 73 bp, Homo sapiens
aggcattgttattgactggttttgaaggaaaatttattttcctccaccctcctaaaccacaacttcaatgtct

SEQ ID NO: 801 - DNA, 87 bp, Homo sapiens
ggtataatatgagctggataattttcacagcatttgatgtactgaatgttgtggggcttttccatgacacataatcagtattaagcc

SEQ ID NO: 802 - DNA, 72 bp, Homo sapiens
ggtggcaggtattagggatgacattcatttagccttctgagctttctgggcagacttggtgaccttgccacc

SEQ ID NO: 803 - DNA, 74 bp, Homo sapiens
tgaatgagcaggccctctttcattcagaagtttatactggggttggactctattgaaacgggctaactcattta

SEQ ID NO: 804 - DNA, 85 bp, Homo sapiens
cttgaacttgctccagtgggtcccggaaattcagcccaggacagacctgcggatcgttttcagagctcactggaatatgtttaag

SEQ ID NO: 805 - DNA, 87 bp, Homo sapiens
tgtttgtaagctattctgacagaaaagacaaaggttactaattgtatgatagtgtttttatatggaagaatgtacagcttatggaca

SEQ ID NO: 806 - DNA, 83 bp, Homo sapiens
ggcctattttattcttccagctgtgtatcatcggcagccctgagtcccaggtgagtaattatagctggagaaagtcaggggcc

SEQ ID NO: 807 - DNA, 82 bp, Homo sapiens
gccatttggtacctgatgtgatcgggctttttcctgtcgtgtgaaaaaacggggcaggattaaaacataagggaaaggtggt

SEQ ID NO: 808 - DNA, 80 bp, Homo sapiens
gtgcttcacttttctttcagcttgagctgttttctcctgggaaaacagctttttgcttggcaaaaatggatgtgaggcat

SEQ ID NO: 809 - DNA, 90 bp, Homo sapiens
tctcacaatcttttgggattggcaattcacacagtgcaaaatcccatttgcaacatagctttccccaatcccatgggattcattgtgaga

SEQ ID NO: 810 - DNA, 83 bp, Homo sapiens
gagacccatcgttctgaatttaaatgtgacttgcagagccaaatgataacttggagcattttacaaaagaatgagggaaactc

SEQ ID NO: 811 - DNA, 72 bp, Homo sapiens
tgacaattaacttgagcaaaatgtaatagacttttttctctcatatttttcatactcaaattaattctgtca

SEQ ID NO: 812 - DNA, 87 bp, Homo sapiens
tcttttatgagtattgttcttccagtagcttcacaaagaatattagtctgtgtgttctcagaggtgatttacaaaactcattaaaga

SEQ ID NO: 813 - DNA, 72 bp, Homo sapiens
ttagagaaagattaaattataatcagtttagtttcagtgttaagtgtattttaatttattctcattctttaa

SEQ ID NO: 814 - DNA, 80 bp, Homo sapiens
ggatcaatgggaatagaaaatgtattctatattttccttgttacatagagttagagcgcatattttattaatgttcatcc

SEQ ID NO: 815 - DNA, 78 bp, Homo sapiens
tccacagagaaactgtactctttcatttctgttgtactagagtataagaaatcaatgacaggtacatctctcttcgga

SEQ ID NO: 816 - DNA, 71 bp, Homo sapiens
gcaacggtccacagcctaactaatttaaaaatgcaaatgaatgctaaattacagtcaggtttggagcttgt

SEQ ID NO: 817 - DNA, 79 bp, Homo sapiens
aactttaatgaaggaatgtacccatgtacatatgtgaactttttcatattgtattatcaaggtatagacttttttggtt

SEQ ID NO: 818 - DNA, 84 bp, Homo sapiens
tcaggagctggaatggggcccagagctctcaagcctctgctcacccgcttgggactggcccttggctccaggccagctccctga

SEQ ID NO: 819 - DNA, 72 bp, Homo sapiens
aggcagctgagtcctgtcatggaaaatgtaaaggccctcccctttttcatttccctccaggaacttctgcct

SEQ ID NO: 820 - DNA, 81 bp, Homo sapiens
aatgggttttaataaactgaggagaattataggcaccatcatcttggttcctgtcaattttacttagagtaaaatgccatt

SEQ ID NO: 821 - DNA, 74 bp, Homo sapiens
gaatactcagtgtttccagctgtacagtttctctgttcttcagggtcattttcacagctttaagatgtgtattc

SEQ ID NO: 822 - DNA, 75 bp, Homo sapiens
atacacaaatttacagagaagggatcaactttaatacatttggagtaaaaggtgtttcttctttaaatatggtat

SEQ ID NO: 823 - DNA, 76 bp, Homo sapiens
cagcctactgcttggcaggaagtcgtttttcggaaaagttaactgaacaaacaccttccattgtctacagaggttg

SEQ ID NO: 824 - DNA, 83 bp, Homo sapiens
gattcatctattctttttctccttcttcaaagataactctgtaagcacttaaggaggggaaagtcattaagaaaagtggaatc

SEQ ID NO: 825 - DNA, 90 bp, Homo sapiens
tttaatgttccatcaggggcaccagaatcctggagcaacttagcaagaagcatagttgctccagggactcgctcagatggtttcattagg

SEQ ID NO: 826 - DNA, 83 bp, Homo sapiens
agtgcagatgcaaataatcctaacaaattattctataaatataccacaaatagcaatactttgtgaggttaatagctcttact

SEQ ID NO: 827 - DNA, 83 bp, Homo sapiens
gtgctgggtgggtggttttttatcttcacggatttatggagtccttaaaacatctgttccgttctgattcccccgctcagtac

SEQ ID NO: 828 - DNA, 87 bp, Homo sapiens
gccgccagcacccgcggtgccgcggggccgctccgaggagcctgagagacccacggaggcttcgcgggaagacgcggcggcggcggc

SEQ ID NO: 829 - DNA, 88 bp, Homo sapiens
tgtgtttacagataaaatcttttgtgttgcagtatactgtagtgtttgcaaaattggaaaagatttaatcaaaataaggtgatacaca

SEQ ID NO: 830 - DNA, 86 bp, Homo sapiens
aagtgttatcaatcacagcttaatctaattaagctctttaaaatagcttctaaactaattagattaagtagtgatttataacagtt

SEQ ID NO: 831 - DNA, 81 bp, Homo sapiens
ttgtcagtaaatcttgttatgaagatggtgggctgatcaagatgacactgagtaacccttcagaactagatgaactgataa

SEQ ID NO: 832 - DNA, 80 bp, Homo sapiens
catgtgatttctgcccagtgctctgaatgtcaaagtgaagaaattcaatgaagcacgggtaaacggcgggagtaactatg

SEQ ID NO: 833 - DNA, 82 bp, Homo sapiens
ttctattaatatgtatcatattggtatccattttcactaatgtgacatgagaggcagtaatgtgattacttttttagtggaa

SEQ ID NO: 834 - DNA, 73 bp, Homo sapiens
gtttatgataatatgattagttacactaataatgctgcttaggcattatcttgctaattacaatattataaat

SEQ ID NO: 835 - DNA, 79 bp, Homo sapiens
aaatgatattgctagtattgactatgcttcctgtgattaaatatttatgaggcagcttagtttactaaatataacattt

SEQ ID NO: 836 - DNA, 73 bp, Homo sapiens
tgaaaaccagactcccctgctgtctaatacctgcatctgagggcagcacagtgaggggacatctttggtttca

SEQ ID NO: 837 - DNA, 77 bp, Homo sapiens
ggaaatgggagaaggataaagtggaaatctaattttgagaaataaggattaaaggttccattattcatgctgttttc

SEQ ID NO: 838 - DNA, 74 bp, Homo sapiens
tctgtttttatcagtttaatatatgatacatcttctatccaaggacaatatattaaatggatttttggagcaga

SEQ ID NO: 839 - DNA, 77 bp, Homo sapiens
gaattattgaggtttaagtgaatccttaagatagctctaaagtgagctcttgactggagcctttatctcattgactc

SEQ ID NO: 840 - DNA, 84 bp, Homo sapiens
ccctcacgaactgtgcggtaatgagaaatccaaacaccaggtgctccaggggctttgggtttgtcacatatgccactgtggggg

SEQ ID NO: 841 - DNA, 70 bp, Homo sapiens
gctggcattatggcagccaggatattgtcaggaggaacttggcagtgctcgtaggtgttatgatgctggc

SEQ ID NO: 842 - DNA, 82 bp, Homo sapiens
ccccagtcctgctggtgctaataaagtgcacgatattactctggtaatatagtgtacaatataaggcatccagatgctgggg

SEQ ID NO: 843 - DNA, 76 bp, Homo sapiens
tatattaccacagtttgatttaaatatagatacagtatataatacttgtctctgggaaaaatcaaattttaatatg

SEQ ID NO: 844 - DNA, 87 bp, Homo sapiens
gtgcagttatgaattgttaacatgttaatacacagttcctttatttcagatgtgtttgtcttgactcactaacagttccttctgcat

SEQ ID NO: 845 - DNA, 71 bp, Homo sapiens
cagcctcaattcgtgcctcacattgcagtccctggggcagtgaagtaatggagggtctgagtctggggctg

SEQ ID NO: 846 - DNA, 77 bp, Homo sapiens
ttgtaaaggagctgatgttcgaacttcttgatcccaagaatgttctggaacatctcatagagttgctccttgctcag

SEQ ID NO: 847 - DNA, 74 bp, Homo sapiens
agcagccaggtgagccccgaaaggtggggcggggcaggggcgctcccagccccaccccgggatctggtgacgct

SEQ ID NO: 848 - DNA, 78 bp, Homo sapiens
ttttacacttctaagcagcttgctagtgaggattgcttatttgcattcatttacatacaatttgcaagaaatgttgaa

SEQ ID NO: 849 - DNA, 83 bp, Homo sapiens
acatgttattgtgggtattggagttaggttatgataatgaatttcagactcaaatattttctttgattgtcacaaaaacatgt

SEQ ID NO: 850 - DNA, 86 bp, Homo sapiens
gcaagatttaattgtgtatatatgtctgtaaggctagcgagggctgtcttgaacaaaaaatatgactatgcacaacaaaatcatgc

SEQ ID NO: 851 - DNA, 75 bp, Homo sapiens
gcgctgcagtggagttattatgcttttgtattatttgtaattatcattagcataaattatacatctattcagcac

SEQ ID NO: 852 - DNA, 80 bp, Homo sapiens
tgtgtcatcctgtgtgctgaagctgctttttaaaggggccaagcctcctttaaacaattctaaatatttttgaagataca

SEQ ID NO: 853 - DNA, 78 bp, Homo sapiens
cgcgcaggagaacgtgctggtgtcctactcgttgatggaacagcgggtgggcgagtgcgcgctgtctagctatgtgtg

SEQ ID NO: 854 - DNA, 89 bp, Homo sapiens
cagattctattatgtgagattgaattggtttctgcaggtggttgcgcaacattctcccctagagatctgtatgtcacatatggtttctg

SEQ ID NO: 855 - DNA, 78 bp, Homo sapiens
ttgtgttaagctatattgaggatgccattcaataattactttaaaatgcatggcgacttcaaatatgaaggaacacaa

SEQ ID NO: 856 - DNA, 79 bp, Homo sapiens
gtttttgatctttattaattatagcgcaggaaagctgacaaaagcaacctgtctctttaatataaacaagattaattgc

SEQ ID NO: 857 - DNA, 74 bp, Homo sapiens
gcagtcttatttgaaagaggtcagaaggtgccatttattctttagaggaattctgactcatttctccagattgc

SEQ ID NO: 858 - DNA, 84 bp, Homo sapiens
gcctgctaatggttctactgcttttgaaggttccaggtctgtgcagcacagtgtgggaccccaggagtgtggatctgtggaggc

SEQ ID NO: 859 - DNA, 70 bp, Homo sapiens
acagatgattttctgtgttagaagatgctatcggctcacctggcctcttagtgacagagaaatcctttgt

SEQ ID NO: 860 - DNA, 87 bp, Homo sapiens
ggtattcacaagtttctttatgttttgaataattgtttcctgttttgctcagcagaacaagtaattaagatgacatttgtgagtact

SEQ ID NO: 861 - DNA, 85 bp, Homo sapiens
atttgctttctgtagttgagcaaacgtcttaaaaagtcatttgtaatttattaaattactttctatgatgttctatagagcaaat

SEQ ID NO: 862 - DNA, 76 bp, Homo sapiens
caagggaattttgtgacatgctggtctgatgctcctctgagccccagaagctgttgtcatgtaaattccactattg

SEQ ID NO: 863 - DNA, 80 bp, Homo sapiens
ggttatttatagcttctttaatgaattcttcttaaacaaagtgaaattatgtcctagaaaagtagaagctattcgtaact

SEQ ID NO: 864 - DNA, 84 bp, Homo sapiens
gagctatggtgggcagagtgctggaacagtctccctttcaaatgagagaggccgctgaattaaacacttgaatataccaagttc

SEQ ID NO: 865 - DNA, 78 bp, Homo sapiens
tgaaaattaggtacctcatgtgataaattattcaagtgttatgcttttgttttgttatagaaggcatctggtatttca

SEQ ID NO: 866 - DNA, 89 bp, Homo sapiens
agcctccttgtctggagattctaacaaatgggtttgcagtgttggaaactgtaaatcctcagggaacagatgatctggacaatgtagct

SEQ ID NO: 867 - DNA, 72 bp, Homo sapiens
ttcattctcacaggaggagtttaatttcagcaaatgtgtttttgagagattttgatgtcctggagctatgaa

SEQ ID NO: 868 - DNA, 72 bp, Homo sapiens
ggacagtcaccatagcaacagtagacatgtgactgcacaggtctctcatagtcactatggcaaccagtgtcc

SEQ ID NO: 869 - DNA, 80 bp, Homo sapiens
tgaagtttaaaggtgagtttgtacaaatatcaaaaactaattaagtagaacaggtgatatttaactactttgagacttca

SEQ ID NO: 870 - DNA, 76 bp, Homo sapiens
ggctccgtcgacgttcggagcctgctggcccgtcgggcagctgtcgggccgcgggagtcggtccgtgggcagggcc

SEQ ID NO: 871 - DNA, 75 bp, Homo sapiens
ccaatgaaggtcagaaagttaaacttatcacccagtagccagggttgatagttcatatcttgatcttatcattgg

SEQ ID NO: 872 - DNA, 78 bp, Homo sapiens
gttaatgcagacaccgacactcagattaatgaaaggaagcaatttattgaactgatatttggtgtagatgtcattagc

SEQ ID NO: 873 - DNA, 77 bp, Homo sapiens
gaagcatgctttcatttactcttctaaagttactgtgtaaactacaagtaattaaaagaaacgcagaaagtagtttc

SEQ ID NO: 874 - DNA, 77 bp, Homo sapiens
gttccgaggcaggctttcctcctctctgcaggggagaggctccctcacacaagaggaggattacactggctctgagc

SEQ ID NO: 875 - DNA, 80 bp, Homo sapiens
gcttcttttatatgggcacgacagacttttcctttggatttttaattagagtccatcaattgtagccatatttaagaatc

SEQ ID NO: 876 - DNA, 78 bp, Homo sapiens
aaaatagatttttcacctgtcaggcagttatttttacaaatgtatgatatgggtactgattagtgaaaatgctctttt

SEQ ID NO: 877 - DNA, 81 bp, Homo sapiens
tcaaatgagaaactaagtacatttcttttcaacaggcaatttaccccatgatgagatatgctttcacttatttttctttga

SEQ ID NO: 878 - DNA, 86 bp, Homo sapiens
gttccagaaggcggcgcgtgcggttgggaacgcggagcggacggattcgattcaacggggttccggaccgcgctgcgctatggagc

SEQ ID NO: 879 - DNA, 88 bp, Homo sapiens
taaaatatattttcgatctatatttgatttaaattgcaaagagaatacacatgaggaggtctccatataggttgcaaaatataattta

SEQ ID NO: 880 - DNA, 88 bp, Homo sapiens
aaagatgatgagctggttattattgctgcctgggaagtctgcaaatatactgggggttatcactgcaataatcttaattatcatcttt

SEQ ID NO: 881 - DNA, 83 bp, Homo sapiens
ccctccttgatctggggaactatttcttcattccagaaggtcagagctctggcaatagtgtccttcagactctcacaggaggg

SEQ ID NO: 882 - DNA, 81 bp, Homo sapiens
gtgggagactaaaaataagacataattggctttggaatcaattaaagtcattaaaaaggtgtctgttcaaagatttcctac

SEQ ID NO: 883 - DNA, 71 bp, Homo sapiens
gagtctgatagtacattggcttgtgtatcaaagggtacttggtacttagtttgcatttactatcatgattt

SEQ ID NO: 884 - DNA, 82 bp, Homo sapiens
aaactggaacacattcctcaagggagcaggaaagcatgagaagacagtatgctattgcaccctgtgatgagagtggcagttt

SEQ ID NO: 885 - DNA, 82 bp, Homo sapiens
tgaaggtggactgaagggtgacaagtgacttgattagaaaggaaatttcatcttgtcacttattacctggaatccaaattta

SEQ ID NO: 886 - DNA, 80 bp, Homo sapiens
gtgggctgcatgttcccgcattgctggtgagggtgcacgatctggcactgcagctggctggtgggagggctgcatcctac

SEQ ID NO: 887 - DNA, 70 bp, Homo sapiens
ctttgttgctgaagctgaaaaaattaactgctatatttaaaagcattgttcagttgctatggtaacagag

SEQ ID NO: 888 - DNA, 77 bp, Homo sapiens
cagtgggattctgggatggttttcaagagccgtggcttctcttgactttcccatggcctattccaagacaaccactg

SEQ ID NO: 889 - DNA, 77 bp, Homo sapiens
ttccctttggctttaaggtttatttagaattcatgaagttgtgtctgtgctgaaaagctttgaaccgttaaagggaa

SEQ ID NO: 890 - DNA, 86 bp, Homo sapiens
agatacaggtatttttcagagttggaagacgtctcgaataaatgagcttcgtatatatatgcttttaatgtgatttgcctgtattt

SEQ ID NO: 891 - DNA, 78 bp, Homo sapiens
gagattccaaaaataacaattttaatttccaaatcgagggcatgatttctaaatggaccaagttatttttgtgaactc

SEQ ID NO: 892 - DNA, 72 bp, Homo sapiens
ccatttttcatacgattaatgtcaggcctctcatgtttcctaatgaaacctgacactaactgagaaaaatgg

SEQ ID NO: 893 - DNA, 78 bp, Homo sapiens
ctgcagtgggaaagtcaagcctggtattacgttttgtcaaagggcagttccatgagtaccaggagagcaccattggag

SEQ ID NO: 894 - DNA, 83 bp, Homo sapiens
ggtgctgttgaagggcaaagggcattttaaagcattggtcttcacataatgctaccaccttgctcttagcttcttccatcacc

SEQ ID NO: 895 - DNA, 81 bp, Homo sapiens
ctggcatttgtcagatcacatgttccaatttttgactcagaaaatatggtcagtgtatccctataccgcaacaaatgccag

SEQ ID NO: 896 - DNA, 78 bp, Homo sapiens
tcttattgttctctcttgcaaccagatgtgctgaagacaactctttcacttaaggtaaattatgtgagaatagtaaga

SEQ ID NO: 897 - DNA, 90 bp, Homo sapiens
gttaatacatacttattctcagaaagataaatctgtaccttgtttagctctaggtttaatatatctgttgagaattaaaaatgtgttggc

SEQ ID NO: 898 - DNA, 81 bp, Homo sapiens
gcctaatttaactaaattgtctttattaacaaggccctattaagtggtttcagctgtaatagcatttgagttccattaggt

SEQ ID NO: 899 - DNA, 76 bp, Homo sapiens
taatacattgtaatgacattttggggattccgccatattttgtatggttgccagcaaaatgttgacagttgtattg

SEQ ID NO: 900 - DNA, 81 bp, Homo sapiens
agtttaaccccacaactttcctctttgctagaactgtaaactactgctacagttttaaatagactttttgttgtttaaact

SEQ ID NO: 901 - DNA, 79 bp, Homo sapiens
tgttctaattgacatcatagccctgagtttatactttcatgcaccatgaaaattcacttcatttatgtcaattggaata

SEQ ID NO: 902 - DNA, 75 bp, Homo sapiens
tgaaaagtacaatttctctgcagggcctgcaatgaaggatttgcagaatcctgcagggaatcaaggaactcttca

SEQ ID NO: 903 - DNA, 87 bp, Homo sapiens
gctggattctgcccttggatacacacaacaaaacccccattgaagtcaatggaaattgtgcatgcatatccaggggcagaatttggc

SEQ ID NO: 904 - DNA, 80 bp, Homo sapiens
tggctctaagccatctgattttactatgatttattaactgctatgcattatatatgagattcaggtttgctgaagagtta

SEQ ID NO: 905 - DNA, 76 bp, Homo sapiens
gaagattgcctatttctgtcttttacctcccttgcatatggcaaggagaaataagataatatatgtgcaatgcttt

SEQ ID NO: 906 - DNA, 78 bp, Homo sapiens
actgcttagcactcctccacttgcgaatgcacttaagacagtaggtgtggttgcagttggagaggatcccgaagcggt

SEQ ID NO: 907 - DNA, 87 bp, Homo sapiens
gcgtgatgatgacttgagtcctttaattgtgaaggcagtttcttttgccttcattatgaaaagggcaaataaggcagttttcatagc

SEQ ID NO: 908 - DNA, 71 bp, Homo sapiens
ctccctcaggccccgcctgcacctttcccagcccccaggactctaggggaagtggtgggtgggggaggggg

SEQ ID NO: 909 - DNA, 75 bp, Homo sapiens
tagtgctaaactcatttgcacaactacagttaattggctacaacaattaattaatgtgttggaaatttggcactg

SEQ ID NO: 910 - DNA, 81 bp, Homo sapiens
atgcaaatgggaaagaatgccacttcagtcattgctagtgaaaattagcatctgtgacactaatggtgtctcatttagtat

SEQ ID NO: 911 - DNA, 80 bp, Homo sapiens
ggtatttgaagatgcggttgaccatggtgtgtacgctttatttgtgacgtaggacacatggtctacttcttctcaatatc

SEQ ID NO: 912 - DNA, 84 bp, Homo sapiens
aatgacatctattaccacattagaggcaacccataacaatcccttatagaatgtttgtctcaattttggttatttaatgtcatt

SEQ ID NO: 913 - DNA, 78 bp, Homo sapiens
caggcattgactttgcttaacctttgcacttgtaataaaaatgcaataaagtaattggttaaaataaagacatgtctg

SEQ ID NO: 914 - DNA, 90 bp, Homo sapiens
tgatgtgatgtaactgatatgccaatcagataaatattgtgtaaaattgcactaaactacagtgacaaatggcatgttatacacacatta

SEQ ID NO: 915 - DNA, 86 bp, Homo sapiens
tccagtgcacatgatttcatgtgatgtttccccaggtaccaatgtactctgacttgaaaagattactctgagtccatgcatctgga

SEQ ID NO: 916 - DNA, 77 bp, Homo sapiens
gctccacgtgagattctgcaaagggattaagatttggcaccaggcttggtttctgtgcagcctcttaggcagagagc

SEQ ID NO: 917 - DNA, 75 bp, Homo sapiens
ttttgttttataaatatagtgactggatttgctgcatttagcagaaaattcattgcttatacttccaaaatgaaa

SEQ ID NO: 918 - DNA, 77 bp, Homo sapiens
tcccagaatatggaggcaccaaagtagttctagatgacaaggattatttcctatttagagatggtgacattcttgga

SEQ ID NO: 919 - DNA, 83 bp, Homo sapiens
taggccgaacctatagtatagaaatattatctattttattaccttgaatatttaatatttttcactgggaggtttgaagctta

SEQ ID NO: 920 - DNA, 85 bp, Homo sapiens
atgcctgctgatcaccatcattcctttaaaaagcagagaaagaaaagctttcaaaagaagggactggttagaactagcatggcat

SEQ ID NO: 921 - DNA, 82 bp, Homo sapiens
tcctgtccagggcatgaggaaatatagatatttattgacatatggtgtcagaagatcgaggaaaattgactctggagaagga

SEQ ID NO: 922 - DNA, 86 bp, Homo sapiens
agcagatgtatgcaatgcactgtgctgtaaagccatgcagcagtatgtaatatgacagcagccagtgctacactttatgcattgct

SEQ ID NO: 923 - DNA, 90 bp, Homo sapiens
ggaattagtgtgttatttggactcacaatattgctgtcccatccggtgaggaagagacggtagtttagaaaacccactttgcctaattcc

SEQ ID NO: 924 - DNA, 71 bp, Homo sapiens
gcagaagtggagctgaatggttagttagcagttctattgcaattactgcactttttcaggtctgctgctgt

SEQ ID NO: 925 - DNA, 83 bp, Homo sapiens
agccagcaacctcacatacttgccttcagtggtaaaggatggagagcctgcctgctaccaatcagcaagtggttgctatggtt

SEQ ID NO: 926 - DNA, 84 bp, Homo sapiens
gcttggtgagaggaggaggaggcagggccgaccgccacccgcctgtctgccatctggtccccttcccctccctcctctcattgc

SEQ ID NO: 927 - DNA, 70 bp, Homo sapiens
tctctaaaaggtttctaaatgatgttgatgttaaaaaatatagtatcaccatttaacagccttttaaaga

SEQ ID NO: 928 - DNA, 83 bp, Homo sapiens
cagctggggcagaggctgtttatttggtttctcattaaccaaaggaagtgcctggatcagatggagcctctgctgcttgactg

SEQ ID NO: 929 - DNA, 87 bp, Homo sapiens
cagagtctaaatggaagagtcctccgtatttacccagctcatctcctgtgtaatggatttggaggagagatttccactggggctctg

SEQ ID NO: 930 - DNA, 88 bp, Homo sapiens
tcccctgtatgtcataacaaccatgtaagggagagtgttttcctgctctgtcttaggtattggtgatgtgacctgttcacgcagggga

SEQ ID NO: 931 - DNA, 71 bp, Homo sapiens
gttttaaatagcacctttgtatccctgctgtgggactcagattcccaaggataaacgaaggggctggaaac

SEQ ID NO: 932 - DNA, 70 bp, Homo sapiens
gtttggtttttggaagctggcatggactagattgaacaaatcagctatgtggttccaaagttttacagac

SEQ ID NO: 933 - DNA, 70 bp, Homo sapiens
agacttatcccagacagtatgccagaggataatgtggaaattatgctcttttgtgtaactgggaaggtct

SEQ ID NO: 934 - DNA, 82 bp, Homo sapiens
ttgggaaaggaaaactaataaagaggtttcactcaattgcttaaaaggaataaactgaattaaatctctgtttcattcccaa

SEQ ID NO: 935 - DNA, 79 bp, Homo sapiens
cattctttttatttcctgcactctggatctattcaaatctcgtctcctgccgagggattcagtgcagaactaaaatatg

SEQ ID NO: 936 - DNA, 86 bp, Homo sapiens
tgtcctgattttatgcaactggtcatttttagttagtatgacataaccaacaatcaaatacaaattagttgcttaaattcaggata

SEQ ID NO: 937 - DNA, 79 bp, Homo sapiens
acactctcctcttgtctccttgtaatcaattcattgtcatcagaaatgtgtgacacctcgaggggaggggaggacgtgt

SEQ ID NO: 938 - DNA, 83 bp, Homo sapiens
gcagctggcaattccagcttgattaccaggtctccagttttgattagtaaattactgtggtaatcaaggttaattctcgctgc

SEQ ID NO: 939 - DNA, 75 bp, Homo sapiens
gatgcttattttatcattccaatttaacagcttgcttagcaaagttgataggtaggagtttagaagatattcgtt

SEQ ID NO: 940 - DNA, 73 bp, Homo sapiens
ctcagtatcttcagcttgggaaactgacctcgttaattttaatgaggggaaaaattctccagctggggctgag

SEQ ID NO: 941 - DNA, 83 bp, Homo sapiens
tgtaattactgtatatatgtgtatagacattaacatgaaattattctcagacttaaattgtctaatattagcagctgattgca

SEQ ID NO: 942 - DNA, 76 bp, Homo sapiens
gtactctgtaattactgtacattgtaacaaatgacctcataaatacattgtaatgtcccatgtaattacatggtac

SEQ ID NO: 943 - DNA, 88 bp, Homo sapiens
gtgccagtcaacatagaagaagctggaagtaaagaattttctgaaagttctattgtacttttgcagagtcttttattgattgtggcac

SEQ ID NO: 944 - DNA, 71 bp, Homo sapiens
gcacattataaactctaattcattaacgtcatcataaatggtaatgtcctgtgaaaaagagaggtggtggc

SEQ ID NO: 945 - DNA, 86 bp, Homo sapiens
atgtaaggaagcacatgttcccagcctgcaattgtgaagtttggttgcaatgtgttagctgcttgctgggccatgtgattcagcat

SEQ ID NO: 946 - DNA, 85 bp, Homo sapiens
aatacataaatgaacgggtattggtgcctctttattttaaaaaatttgaagaaaagagccacctcatattcatagggtgtgtatt

SEQ ID NO: 947 - DNA, 81 bp, Homo sapiens
tgtgctctcattgttattccaaaagtctctgtctagatcactggaggggcagagagagaggggagaaaacagggagataca

SEQ ID NO: 948 - DNA, 87 bp, Homo sapiens
ggaatgatcataaagtacttggcacacatgaagggcagcttaaataccaattagtaattatgtagcgcctttctgccaaggagttcc

SEQ ID NO: 949 - DNA, 78 bp, Homo sapiens
gttctagttccaggatgctgatactttaagcccgaggctctaacttgagcaggaagagtttattttgggatgaagaat

SEQ ID NO: 950 - DNA, 70 bp, Homo sapiens
agccttttcttcagtcgttttctccagctgacttctctgaagttattggtgaggaatactgccttgggct

SEQ ID NO: 951 - DNA, 72 bp, Homo sapiens
acttagaggagtgacaaatttggtacttaaaaaatatttaggttaaaaacaaccctgtcacttctactaagt

SEQ ID NO: 952 - DNA, 80 bp, Homo sapiens
gactgcaggcattttcctctgcctctgtcaagtgtaattctttcttgatgaatgacaaggcaggataataggctgtggtc

SEQ ID NO: 953 - DNA, 70 bp, Homo sapiens
attcttggattcatacagtgatttcatggtgttatgtgttgtgaaacattgcactgtatgaatctggaat

SEQ ID NO: 954 - DNA, 83 bp, Homo sapiens
ctaattagatctgcaatctttccctttgtaccatcacccagtgacagagtaaatcagggtgattgggatgcagataggattag

SEQ ID NO: 955 - DNA, 86 bp, Homo sapiens
caggctgacaactgatatcacaagaccacagctaagagtggtttattacttttagtgggatttatttaattcagtctcacagcctg

SEQ ID NO: 956 - DNA, 72 bp, Homo sapiens
attttctggatataaatgcaactgaatttaattggaaaagccttgaatttaggagccaatcatccagaaaat

SEQ ID NO: 957 - DNA, 90 bp, Homo sapiens
ctttggaggcagaagctctggcccctatggtggtggaggccaatactttgccaaaccacaaaaccaaggtggctatggcggttccagtag

SEQ ID NO: 958 - DNA, 87 bp, Homo sapiens
ttagcttaaagttggcataatacctagctctatgcacgtacgttgttatttttaagcaatctatgtgtttagatgccatcaagctaa

SEQ ID NO: 959 - DNA, 78 bp, Homo sapiens
acatgtgtttggtgttagatgtaaactagtgtagccaaagtgggcaagtgctgtaaacttcaaacataaaacagatgt

SEQ ID NO: 960 - DNA, 75 bp, Homo sapiens
gccagaggaagagcttttcaaagttgcagtaacttttggcagaaatgtcatagtactgaagattcttcttttggt

SEQ ID NO: 961 - DNA, 73 bp, Homo sapiens
tcttgttatatgtgaaaagttaactaagataatattaatattagttttagtaaatgccctgcagttaacgaga

SEQ ID NO: 962 - DNA, 71 bp, Homo sapiens
tgagtgtctgaaatgccaatattttgtgttgttgataaaacgatccatatgttttacatttcacacactca

SEQ ID NO: 963 - DNA, 87 bp, Homo sapiens
ccctcccagttcccatagcaactgggctgtagcagccagaacttgattgagcccagcagtggcccgactgaggtggggaaaggaggg

SEQ ID NO: 964 - DNA, 78 bp, Homo sapiens
tagcgagttcatttctatttgtttgttgtttagttagttggttgactgttacgagggagcaggtgggaaggctggcta

SEQ ID NO: 965 - DNA, 81 bp, Homo sapiens
aaccacagagagtttgacaagtttgtgttatgatgttggcttggctttgtatttttaattaactttggatttttagtggtt

SEQ ID NO: 966 - DNA, 73 bp, Homo sapiens
ttggaaggaaaacatacctgacagatttttcgacttaatgatagataatgtcatagatgttttcttgtatcag

SEQ ID NO: 967 - DNA, 81 bp, Homo sapiens
agtgcaatttgtgtataacattttagtacttaaatcaactatgaaaagcattttaaattaaaatccaatacactttgcatt

SEQ ID NO: 968 - DNA, 85 bp, Homo sapiens
atgtcttgaatgtttaatatgactaatcacttcttgctttggaaatgagcatcttctttgataagttgttcaagtgttcaggcat

SEQ ID NO: 969 - DNA, 86 bp, Homo sapiens
ctccctcctttgtaggatatgcttcttattctggattagtaacacctaaatcctggaatcaagcatgaaacctacttttgcaagag

SEQ ID NO: 970 - DNA, 81 bp, Homo sapiens
tctgctaattcagtattgatcttgatactaagatatgttatggtcttagaaattcacttgagtccctgctgaatgaaaaga

SEQ ID NO: 971 - DNA, 78 bp, Homo sapiens
ttgagcccttgtacataatgaaaggaggctgtgcataaaagccagttattcatttattctgtacattagaggcttcaa

SEQ ID NO: 972 - DNA, 73 bp, Homo sapiens
aattacttcaaactgcctttcctgttgagtaggttttgaactacctgcttgacagatggtgttagaagtaatt

SEQ ID NO: 973 - DNA, 74 bp, Homo sapiens
catccccattaattatgattgatataccaactggagaataagtgcattaatgctataattatctgttggggatg

SEQ ID NO: 974 - DNA, 70 bp, Homo sapiens
aactactaaataagacctttaattactgccaatcttctcttgaaagtagcagtgcttatcttgagtagtt

SEQ ID NO: 975 - DNA, 90 bp, Homo sapiens
ttagagagaaaccaattctttggtctattttcttggtagctttactgattgccagggaaaatgaaaaccagaaaattaattaatctctaa

SEQ ID NO: 976 - DNA, 82 bp, Homo sapiens
ctgctgatctggcatggaataacatcaaaggaaatgcatggcagaccacaattttccagcatgttgttccagcctgaagcag

SEQ ID NO: 977 - DNA, 77 bp, Homo sapiens
gctgggggtcatgtcgaggttccacaccctgccgtgtgcagagagtggcatgcaaacatttcgacaaaggccccagc

SEQ ID NO: 978 - DNA, 74 bp, Homo sapiens
gccacctttcatggtgaggatgcctgccaccttcaggatcacatctttgggtgaggtccaaccagagagggagc

SEQ ID NO: 979 - DNA, 78 bp, Homo sapiens
tggttcccccaccacaagcccaaccatgtgttactatattaaaaaatgtgaaaaagtaattatggggtatgggagcca

SEQ ID NO: 980 - DNA, 71 bp, Homo sapiens
tttaagactccttttcaagggcatttgtcttcctttaagagaaggccaaagcagaaaagacgagttttaaa

SEQ ID NO: 981 - DNA, 83 bp, Homo sapiens
gaaaatcagttacacaatatgtgaagtgctagaaaaattggcagaattcttcacaatcctccctaatgtgttcctgaagtttc

SEQ ID NO: 982 - DNA, 71 bp, Homo sapiens
caaattacatctgtttatgcttctatttgttagacaatctggcaccgggaacagctgagcagaaggatttg

SEQ ID NO: 983 - DNA, 82 bp, Homo sapiens
ttaatctcacagctgtctctgtaactctcagtactcataaatcatgtggtctgtaataagagaagtaagtttgagaggttag

SEQ ID NO: 984 - DNA, 80 bp, Homo sapiens
tctctgtgtgacttgatataaattgtgttaattaaacatgccattgtttagaagcaacatctaaaaacaaccaccagaga

SEQ ID NO: 985 - DNA, 86 bp, Homo sapiens
atgcagatttaattaaaaattagaagcagattcaattaaattaatgatccttggaatctgaaaaataatttgcaaggaatttgtat

SEQ ID NO: 986 - DNA, 82 bp, Homo sapiens
aggggtgggggtggcagggcccagcgggctggcaggcaaaccctggttttggcccagggacctataatcagctcctgcccct

SEQ ID NO: 987 - DNA, 73 bp, Homo sapiens
ttgcatcactattgatggagttaggtttgcatttacctattagtgttcttataaatctcattaatagatgtaa

SEQ ID NO: 988 - DNA, 80 bp, Homo sapiens
catgttgtgctggaaattagtgtctagaaccaaaatgttaatcacagggacctctatacattgatggcataaatagcatg

SEQ ID NO: 989 - DNA, 79 bp, Homo sapiens
gtcacttaacatttcaataggttaatcaattgacaattaaatagagaaattggttaactctgaaaacaattaacatgac

SEQ ID NO: 990 - DNA, 85 bp, Homo sapiens
gggctggtgtctctcattacagttagagtgagtgagaggacctcagaactaatttacttgctctcactagggaagacacttgcct

SEQ ID NO: 991 - DNA, 74 bp, Homo sapiens
cctttgtgttctgacattgatgttactgtcagttgacagtgagctttatcatcaatcccttcaagtacaaaagg

SEQ ID NO: 992 - DNA, 87 bp, Homo sapiens
gggcgcaggtgtcacattttatttggacatcctctgccatcttgggccagaggaatcatgccctaattagccccagcatctgttccc

SEQ ID NO: 993 - DNA, 73 bp, Homo sapiens
ggcttaaatttattaattgattttatccattttgctttgaaaaagtaaataagtaaagtagaataaatgagcc

SEQ ID NO: 994 - DNA, 88 bp, Homo sapiens
ccccaccgggtcacagactgtgacagagtcttattgcctgtctctgggaattcattttctgtctctcctctgttccacctctctgggg

SEQ ID NO: 995 - DNA, 72 bp, Homo sapiens
agaaataaaacaaatataaattatgcattttccaacttaatttaaaatgcattatgctttgctttgttctct

SEQ ID NO: 996 - DNA, 90 bp, Homo sapiens
ttgcaatggatttgtgctaatgtggttctgctttgagctggctccggtttaaatcaatccagaccataattaagccaagttgaaatgtaa

SEQ ID NO: 997 - DNA, 74 bp, Homo sapiens
ggcttgcagaatgtggatgtcttcgcgggggaggtggccacgttctcctgtgaggtgtctcacgcgggtgggcc

SEQ ID NO: 998 - DNA, 76 bp, Homo sapiens
agtcattgtaaacagatccattggaaacaattcacttttctattgtttcaggattgatcttctcaaacacatgatt

SEQ ID NO: 999 - DNA, 90 bp, Homo sapiens
ttaggatgaaataaagtttattccagcaatctgcttagcagccttgttaatgtcaaggctaatgagtgctgctgatgaataaattcctga

SEQ ID NO: 1000 - DNA, 84 bp, Homo sapiens
ctcaaatatgaatttcattaaggattatgcagtatagacacacaaaattatgaatcattaattctcttgaaattttcatttgag

SEQ ID NO: 1001 - DNA, 70 bp, Homo sapiens
tgcagatagagtgtaagattacgtcatgtgtcgtgcccgagcaccacaaatgactctatacttcatctca

SEQ ID NO: 1002 - DNA, 77 bp, Homo sapiens
taccagtatgctcaacaacttattatgcaatcacatccttggcattttgtatcctaatctgaattgttgagctggta

SEQ ID NO: 1003 - DNA, 73 bp, Homo sapiens
ccaggagagctggctggttggggagaagacactaaccctgtgagtctgacctcagccagctaacctgccctgg

SEQ ID NO: 1004 - DNA, 82 bp, Homo sapiens
tgtggggcttgccagtcttgttcccccagtagcctctgtgcacggggacaatggagagcttgggcaggatgatagccccacg

SEQ ID NO: 1005 - DNA, 77 bp, Homo sapiens
agacccttggcacgtaattatagtgcttctttaaaggagaccccataaaagatgcatgattagaaagttaaggatct

SEQ ID NO: 1006 - DNA, 74 bp, Homo sapiens
aaatgaaaattcataaagtatatcattaggactccttataagcagcattatgattatggtatgaatttggattt

SEQ ID NO: 1007 - DNA, 87 bp, Homo sapiens
agaattaactgctggacccagaggctgaaggcacgttgaaggaatccttcatttcttgagcccttggtttgaaaagctagtgatttt

SEQ ID NO: 1008 - DNA, 86 bp, Homo sapiens
tttactgtcagtgaatcgagaactagaggacttagctctgcaaatacagcagccctctatacttcggtacatctttggcgtgtgaa

SEQ ID NO: 1009 - DNA, 71 bp, Homo sapiens
gagagaaatataattaacagtgctctatataaaacacaagttatgtagaccatcacactttaattactctc

SEQ ID NO: 1010 - DNA, 89 bp, Homo sapiens
tttccttctggatgttttatgatgcatttattgttaaccagtcttttactattaacttaaatgtccacttgaaacaaacagttctgaga

SEQ ID NO: 1011 - DNA, 73 bp, Homo sapiens
tgtcatttgtccattttctcttctgacccagtggtattctgcaagatcagaggggagagaaggattaatgtca

SEQ ID NO: 1012 - DNA, 88 bp, Homo sapiens
gcgtggataatcagaatttgattgtaaagtatgcccaggccaaatacaagggcttttaaaatcgtctgctgttttagattatccaggc

SEQ ID NO: 1013 - DNA, 80 bp, Homo sapiens
ctttgtaaactgagcacttttcaaagagagctccaaattcctacagagctgtctttaagtgagctttgatctttgcagag

SEQ ID NO: 1014 - DNA, 80 bp, Homo sapiens
tgttatttgtctatttttagaaataaaatgtgactacattgaacaatgtactcataaaaagtcctcttagaatagtaaca

SEQ ID NO: 1015 - DNA, 84 bp, Homo sapiens
taactttatcccctcctgtgttattgttgttgtaccacatattaatgtggggcttctgtagctgagaggagtacggttgagtta

SEQ ID NO: 1016 - DNA, 77 bp, Homo sapiens
atggactatttagggtaaattttaaaatagggcttgcatatcctactaagatgatttttaccgtacaatagtgccat

SEQ ID NO: 1017 - DNA, 90 bp, Homo sapiens
tctaattttatattagtgatggttgctaggtaattttttgatgcaaattaatcattaaacactagcagctcattttctgattggagtgga

SEQ ID NO: 1018 - DNA, 78 bp, Homo sapiens
tcagaagttatggaaggttttggggtaagcccgagaatctctgggcacctgtccaaaatgaacctctaagtcttttga

SEQ ID NO: 1019 - DNA, 74 bp, Homo sapiens
tgaggaaaattggagataatttatgccgtccagaaggaaaagctttgcatgattattatttttgcttttgctca

SEQ ID NO: 1020 - DNA, 84 bp, Homo sapiens
gaattctgtcaatcaactccaggccaaactttctcattatgtgtttgctgaaactatatgatggaatttgtctggtgacatttc

SEQ ID NO: 1021 - DNA, 85 bp, Homo sapiens
gctcagctgaagatggagtgctaatctagggggactcgaaatggctctgtcattttctagatgacagctcctattttccactggc

SEQ ID NO: 1022 - DNA, 72 bp, Homo sapiens
gggtagaaggcgggaagaaatctgttgacacagttatataaagcctgtcattcagtcccctgcctattacct

SEQ ID NO: 1023 - DNA, 70 bp, Homo sapiens
gtggactctagagggtttgcattaagctttgcagtaactgttatggtttgtgttgcgtcaggagttccac

SEQ ID NO: 1024 - DNA, 80 bp, Homo sapiens
tgtgtgataatgggcacatatgctcattaacatgctgtcataaacagctgtgttaaatgtattatgtgttctgtgacata

SEQ ID NO: 1025 - DNA, 73 bp, Homo sapiens
tgatctcttttcctctggggaaatgaaatttattaatcataataaaaccattggattctgaaggtagaggtca

SEQ ID NO: 1026 - DNA, 81 bp, Homo sapiens
agactgatgtgatttattgtgctaatgaaatttccttgagctgtttgttaattggaatatgggacaatgtaatatctgtct

SEQ ID NO: 1027 - DNA, 70 bp, Homo sapiens
gatatttttatgagatacatgttcaaggcattctttctgtctttgcagtttttctctcataaaagatatt

SEQ ID NO: 1028 - DNA, 89 bp, Homo sapiens
ccacagaaaactgagtatgtattgtagaaatgtagaggaaaaataaaaatattttttcaaatgtaattacttttaatatatgcttgtgg

SEQ ID NO: 1029 - DNA, 76 bp, Homo sapiens
aaagacagttacttttctccactgtgctgctaccaccaatttggtggctattaatagctggcagattaacttcttt

SEQ ID NO: 1030 - DNA, 83 bp, Homo sapiens
gaatttttcaaaatgaaataatttatgacattcaagtggcctaatggcacacttgaagtgaattgctcaccttttggaagatc

SEQ ID NO: 1031 - DNA, 82 bp, Homo sapiens
catggttgaaaattctgtttgagaaatatggttagactattttgacaatttttaacctgcttaaattggattttttaaagtg

SEQ ID NO: 1032 - DNA, 84 bp, Homo sapiens
catatgctaggagcaaggttaggagtgaaggaccatgggtcattgacagtcgccctaaaacttttcccttgttcttcagctgtg

SEQ ID NO: 1033 - DNA, 89 bp, Homo sapiens
ttcaaagaaattacttagcaattaaaccttcagcaaaattgtaattcattttaaatttagcacggaggtttgatgctgtttctgaggaa

SEQ ID NO: 1034 - DNA, 79 bp, Homo sapiens
ctgacagtaaagtaatttaattgcactgttgctatgacaacatgctgctctctttctttttaatttgcttatttgtcag

SEQ ID NO: 1035 - DNA, 81 bp, Homo sapiens
tttttacaggaataaatcatttaaccatattaagatttgaaagggttataaatggtttattttcagccatcattgtgaaaa

SEQ ID NO: 1036 - DNA, 85 bp, Homo sapiens
catacgaatatgtaggtcattggattttcaaataaattagagaatagtttatctattaaggaagattcgctgtacatattttatg

SEQ ID NO: 1037 - DNA, 77 bp, Homo sapiens
tcgttcccggatctggtgggtgaggttttcgatcagggcaaatacctgatcacagaccttcacaggattctggatga

SEQ ID NO: 1038 - DNA, 70 bp, Homo sapiens
caggagcgtgatgcctacttgggtcagcggctgcacagcaggtgcggctgctgctggggcagggctcttg

SEQ ID NO: 1039 - DNA, 70 bp, Homo sapiens
gggaatctattctccccatttccaaaccatgatctgaatgggcactgacaagtggagagaatggatatct

SEQ ID NO: 1040 - DNA, 82 bp, Homo sapiens
atttaaagagaattttatttacagttatttcaaatgtagagaatgtaattttctgaactgtacataagtgctcaatttaaat

SEQ ID NO: 1041 - DNA, 83 bp, Homo sapiens
tcctattttgagctgtgatattttaatctccattcttgctgcaacttagcagatgaatgtgcagtgtgacagagctcagagga

SEQ ID NO: 1042 - DNA, 82 bp, Homo sapiens
cagccaattctgctgtgatgggaagaggtgctgtattagtgccaatacattaaccaacttttcaattgcagcagggaagctg

SEQ ID NO: 1043 - DNA, 83 bp, Homo sapiens
tcccacacatactcatggaatctggaagattagcagtgaaaaatgacctattttaacaggtgcacacttgtgtgtaagtggga

SEQ ID NO: 1044 - DNA, 85 bp, Homo sapiens
gataattacaaaaattatcactttgcttctgctgagagctgcctgctaccttaatacacagtgaagtgaaagttttgtaattgtc

SEQ ID NO: 1045 - DNA, 86 bp, Homo sapiens
tcatggcagcgacccacctccagtcccctggacaatcgggtacaagagacttaaggttgggcatgggaagggtggggtttccatga

SEQ ID NO: 1046 - DNA, 73 bp, Homo sapiens
ggggcttgccaagaccccagatgccaagctttggaacattctagtagcaacatctggccttttggtgagctcc

SEQ ID NO: 1047 - DNA, 73 bp, Homo sapiens
ataagagatttaatgttttcatttcttaaaatgcttgaccaagtcttttagtcattatattagcatctcttgt

SEQ ID NO: 1048 - DNA, 70 bp, Homo sapiens
gggcagcagcaggcgctcggccgtctggatctccctggaggtgatggtcgagcgcttgttgtaatgcgcc

SEQ ID NO: 1049 - DNA, 76 bp, Homo sapiens
ctcagggagccccaaagggtttatgggtctcccaatgaatgggagcctgttgagctcggagggggccgggcccgag

SEQ ID NO: 1050 - DNA, 89 bp, Homo sapiens
tctccttctttcaaacatgtcagtgaccaatttcctacagtaagtttagtgggtcctggtgctgacagtataggttgacttgaagtaga

SEQ ID NO: 1051 - DNA, 73 bp, Homo sapiens
aggccagcaaacttcgggaagtgtctgtggcagcttgaatgctgctatttcagagctgatgaagaggcagctt

SEQ ID NO: 1052 - DNA, 80 bp, Homo sapiens
aattggaattatcttttatctttggctacatttatctgaggatcccttcagaaagcccaccagaagctcaaattccaatt

SEQ ID NO: 1053 - DNA, 83 bp, Homo sapiens
tagtggtcaagcttgtttcttctgggggcactcttccaaggatatttgggctgcctccagagtcgcagtgtcttgggccactg

SEQ ID NO: 1054 - DNA, 80 bp, Homo sapiens
gtcccagctataattcagctgtaacgttccttcgagcaaatgttatggaggaataaatgacttgccgagtgtgctgaggc

SEQ ID NO: 1055 - DNA, 69 bp, Homo sapiens
atgcactctgctgtcatttgcagcctgacctgcaggtcaggggtgatgtgagctggctcagggatgcat

SEQ ID NO: 1056 - DNA, 74 bp, Homo sapiens
atggaatgcacagaaggtgacattctgtctgtaacaataggttataattatcatgtctctcatttgtattccat

SEQ ID NO: 1057 - DNA, 76 bp, Homo sapiens
ttttaatgtaatgttattatcctgtcatttaatttagcaatgacaagtgatgatgagattttgatttgcattagaa

SEQ ID NO: 1058 - DNA, 88 bp, Homo sapiens
ggcttcagcaatttatggagttgttatttgcaccaccaaaccagtcaggaatgaaaataacaatcaactccttaaatgtttacaagcc

SEQ ID NO: 1059 - DNA, 83 bp, Homo sapiens
acacttgcttgccaggaattgtgttagctgcttgcaaatattgatctatgtttgtacagtgatttatagtttgcaagatatgt

SEQ ID NO: 1060 - DNA, 75 bp, Homo sapiens
gatgtcttgcaaaaattgctggaatctttacaggagaaccacttccaagaagatgagcagtttctgggagccgtt

SEQ ID NO: 1061 - DNA, 77 bp, Homo sapiens
cgtcttgctggctccccaaggcttccaggcatttgcccatctggtgaggcctccggagcaggggggctaattaggcg

SEQ ID NO: 1062 - DNA, 88 bp, Homo sapiens
gggctggggtaatgaactcccattggcttccttcacgagatcactgccttaatttacgaggcctgagtgagtctcatttccccagtgc

SEQ ID NO: 1063 - DNA, 82 bp, Homo sapiens
gtgtacgatacataatatttggtagcttgtaaatgaaataaagaataaagttttatttatggctacctatgtgtttgtaagc

SEQ ID NO: 1064 - DNA, 73 bp, Homo sapiens
gggcccaggctgtagatgaacttgactggccacctcaggcctcatcctctggctcgtctgactccttgggctc

SEQ ID NO: 1065 - DNA, 84 bp, Homo sapiens
caggggcgcgggccggagagcgggtgtgcaaagtgggcgcagggccctggggccgcgccccttgctctgccggctcgactcttg

SEQ ID NO: 1066 - DNA, 84 bp, Homo sapiens
cttcggttcattaaattgtttaatatgagcactaatttttacaatcgtgtaataaaagtaggtgttttccaaaatgaaccgtag

SEQ ID NO: 1067 - DNA, 85 bp, Homo sapiens
actccactctttgttgcaacttgctgactcgggtgtcccttgccaaaaaggggtaggtggtaggttacataacaaggattggggt

SEQ ID NO: 1068 - DNA, 82 bp, Homo sapiens
agctgtgatggatctgttggcgggttttggatgtgtaaagaatgatatatatattaaataggtcaatcagactatgacagct

SEQ ID NO: 1069 - DNA, 76 bp, Homo sapiens
caaacttgaacttcagtatgttagattttcagggaaaacaccatccctgtgatttagattgctatgtttttctttg

SEQ ID NO: 1070 - DNA, 77 bp, Homo sapiens
ggcattaaatctatcctcagttaacccaatgtctttaataataaagaagattttgcactggggataaatactgtgtc

SEQ ID NO: 1071 - DNA, 84 bp, Homo sapiens
gacatgacattgcagatggattttttgtgtaagaatgtgtgtcattatatgcaagattacattaatctttcatgcttgtctgtc

SEQ ID NO: 1072 - DNA, 76 bp, Homo sapiens
attcaacacagattcaggtgctctcaacagccatgaaaatatatggctgaagagggaatctataaatgtaatgaat

SEQ ID NO: 1073 - DNA, 75 bp, Homo sapiens
gtgcctcttctccatccagatgtagcagttgttctgggccaccccagtctgtgagtccaggaagggaagacgcac

SEQ ID NO: 1074 - DNA, 83 bp, Homo sapiens
ggtttagatggcagtgctgcaaaggaggcaacggaggagcagtctgctctgccaaccctcatgtcagtgatgctagcaaaacc

SEQ ID NO: 1075 - DNA, 80 bp, Homo sapiens
tgctagaggaaataaatgcctatgtttatgtggaaaatatgaccatataacataattgggagtatttaaattctttttca

SEQ ID NO: 1076 - DNA, 73 bp, Homo sapiens
atagtttattacatgattgcacagagtgttaactttaatgccttaatacatatgtgcaatttggctgaattat

SEQ ID NO: 1077 - DNA, 87 bp, Homo sapiens
gccatgctcagagagtggttctttgtgtaggttgtttaacagtgttgtgccagcctacaggaggaaaggccagcctcacagaagggt

SEQ ID NO: 1078 - DNA, 78 bp, Homo sapiens
gccagaatcccagtttgctgtagaaataagcctggacttgatttgagtcttctcagctctgacaagctggaagctggc

SEQ ID NO: 1079 - DNA, 78 bp, Homo sapiens
tgtaacgctgcaggtgcacaaatgctgataaacctccttaactcgctgtcagatcagcatgtttatctgcaagctgca

SEQ ID NO: 1080 - DNA, 83 bp, Homo sapiens
aaaaggtgaagtgaaatttggtcccaatggaaacctgttaggttccctgaacatatggctcattgggctgttacttccttttt

SEQ ID NO: 1081 - DNA, 80 bp, Homo sapiens
tacataagaaatagattgcaacatgtagttacatttttcatcctttgtaatatgctttttgcatccatacttctaatgtg

SEQ ID NO: 1082 - DNA, 76 bp, Homo sapiens
acaacagaatagtcaaggctatggttttgtccaatttaaggactggacttgacaagaccaccaattgttctgttgt

SEQ ID NO: 1083 - DNA, 88 bp, Homo sapiens
ggagatgtgcgccccctctgccacgcccccaccttcctggcaggtggtgggccaccagggtggtgggaagtggccggggtttctctcc

SEQ ID NO: 1084 - DNA, 90 bp, Homo sapiens
cagattcatgattcatttgttaggggcttagtgggcacattttggctgtcagcctgccatgtgcccatgccgggcattgagtgagttctg

SEQ ID NO: 1085 - DNA, 85 bp, Homo sapiens
ttctgtaactcaccaggttgggataggacagaactattgatttttgagcatctaggttcctgttttcttaaccctgtttgcagag

SEQ ID NO: 1086 - DNA, 89 bp, Homo sapiens
tattgagagtttctattgtgtttttgcctcagagtgataaaaggcaatttggcctttactctagggatttataaaagatatttgcaata

SEQ ID NO: 1087 - DNA, 88 bp, Homo sapiens
tttaggtgttaagctttttaggaagagtgaatgatggctaatgattatttaatgacatctctggactgaaaggcatttagcactcaaa

SEQ ID NO: 1088 - DNA, 84 bp, Homo sapiens
tcatgagtgtataactgtatttaaatcatttatatattacattttacaaatgtaatagggaaatgtgttcttttgcattcatgg

SEQ ID NO: 1089 - DNA, 86 bp, Homo sapiens
gcttgcgcttcttgccgtctttcttctgggctttggtgacggctttcttggagcccttcttgggagccggcgcgaactttgcaggc

SEQ ID NO: 1090 - DNA, 85 bp, Homo sapiens
ggggaaatagtttcttttcatacggggccagattctcatctgatgtaagtcttggagaattagccgacatatggaaattatcccc

SEQ ID NO: 1091 - DNA, 73 bp, Homo sapiens
ggattcacgtcttccagccaaaaccatctcaaacaagtagtttgaggtttttgctggaaggtaatttgaattt

SEQ ID NO: 1092 - DNA, 76 bp, Homo sapiens
cccagttgctgctattaagttttagtgttattgccataaatcaaaataactctatttactggtgggagggggtggg

SEQ ID NO: 1093 - DNA, 81 bp, Homo sapiens
gttcagaggaagtagcagtatattttgcacctcatttatcaaacttgtttgaagtagcaattatgtgcatgcttcatgagc

SEQ ID NO: 1094 - DNA, 88 bp, Homo sapiens
aggtgatgttttcagaaattgatgtcaagaataaaatagctgttggcagttacaactgtttggatgtcattttacaaaacaattgcct

SEQ ID NO: 1095 - DNA, 86 bp, Homo sapiens
gtacagaggctcatatgcaaaatattaagttatggcagaatttttctgcaaatatttattctgctttgatactgtagtagttgtac

SEQ ID NO: 1096 - DNA, 70 bp, Homo sapiens
gcttcgtttattgacttagagaaagtaaatggcatttcaaatacaaccttcatacttcaatagatgaggt

SEQ ID NO: 1097 - DNA, 75 bp, Homo sapiens
ttatctgatttaggggctgatggggtttctaatggaaaacaatatggtaatttcagaatgttcctgattagatga

SEQ ID NO: 1098 - DNA, 80 bp, Homo sapiens
gttgcctgttaggtttagccttcctttcaaaacaaacaggattcatttctgttttgaaaagttaagccctactaagccac

SEQ ID NO: 1099 - DNA, 81 bp, Homo sapiens
tgtattgtagatgaatgcagcttctttcatgaaatcccataaggtgtttctgcaatgagcaacactcatttaacaagtgca

SEQ ID NO: 1100 - DNA, 90 bp, Homo sapiens
gcaattagaatgcagggaggttcagaagctatttaactgggtgacccctgaggtcgctgcatctgactcccatccctggataaatattgt

SEQ ID NO: 1101 - DNA, 83 bp, Homo sapiens
cagaaaggttttcacttaattagaatctcatcagagcttccatctgcatcaagattttgataatagaggtcaagaccttttgg

SEQ ID NO: 1102 - DNA, 80 bp, Homo sapiens
atgttgccaaaaataaagtgaacagatatagagtgaacaaacacggaaatgtgtctttccatcttgttttggcacaacat

SEQ ID NO: 1103 - DNA, 72 bp, Homo sapiens
atggctcacagatgttgcagctaaaatagatcctcctggaactatttggtttgagaaaatctctgttgccat

SEQ ID NO: 1104 - DNA, 73 bp, Homo sapiens
ttgtttgtttagatatatggctacaattcaacaatcttgtgaattccatttagtccaagtatccgacagatga

SEQ ID NO: 1105 - DNA, 75 bp, Homo sapiens
tgggtgatgctccagaatgggagatgagccaatctgggagcagattggatccagcttcattcagcattactacca

SEQ ID NO: 1106 - DNA, 81 bp, Homo sapiens
caaatgtgggagcttggatcaatgttgaagaataattttcatcatagtgaaaatgttggttcaaataaatttctacacttg

SEQ ID NO: 1107 - DNA, 83 bp, Homo sapiens
gtacatagctatatattgtttaaaataaacagggaccttatgttatgtccattgtgattatatacaaaagcgttgctgtgtgc

SEQ ID NO: 1108 - DNA, 85 bp, Homo sapiens
gtatttaattagataatgtttgcaagtactttgaagatataaagtgctctataaatgctaaatattattattattgtttaaatac

SEQ ID NO: 1109 - DNA, 71 bp, Homo sapiens
agtataaacattgtactgctttgctaataaaacccaaaatagggagagaaaggatgatacagtgttatgct

SEQ ID NO: 1110 - DNA, 81 bp, Homo sapiens
gacctgttattagcaactctgccatggctcaggattaaatatcaagagagatgagagcagcagttgctgtttttaagagtc

SEQ ID NO: 1111 - DNA, 74 bp, Homo sapiens
cctgaactgacaggctgggcctggctttagattacgttatcacatcttagagcgaggcttgtatgtacctcagg

SEQ ID NO: 1112 - DNA, 84 bp, Homo sapiens
taatgaatcataaattttatttcaaaatgtaaacatcactaaacatgcatacacattaaaacaataaaatttacaatttcatta

SEQ ID NO: 1113 - DNA, 73 bp, Homo sapiens
cagtgcttggtatgcaagaagtgtatcaaaacagatacttttctgtgagattttacttgcaaattaagctctg

SEQ ID NO: 1114 - DNA, 84 bp, Homo sapiens
tggctttcttttataactccatgaaaaatcaaattagtttccactttggctaaatatttcatcatttgtggttagaagatgcca

SEQ ID NO: 1115 - DNA, 89 bp, Homo sapiens
gctcacatgggaatccaaaaccttctaattttctatacagattcatttcagaatcaattagagttggtggcagccttctccctgtgtgc

SEQ ID NO: 1116 - DNA, 78 bp, Homo sapiens
gagcccagatcccaaatatcaatagcttttagtattgcaaattagtttgtctattgggtaaattgggctgtgtggttc

SEQ ID NO: 1117 - DNA, 90 bp, Homo sapiens
gcctctgtgcgcatggatataatcagctttgataggcagaggctgaggctgtttttccaattagagctgttagaggattctggcaggggc

SEQ ID NO: 1118 - DNA, 85 bp, Homo sapiens
gggggcgaggctatgtcgcggtggcagcccggatgggccggcagggccgggagtaacgggacgtcgccgcggagcttcttccccc

SEQ ID NO: 1119 - DNA, 79 bp, Homo sapiens
cagcatatgctctgcaagtacttccaagaaccacctatatcttggcacttaaatacttcacaacagagaaaatgtgctg

SEQ ID NO: 1120 - DNA, 86 bp, Homo sapiens
gctaactgcagatgctgtaattgtctgtcataaatcttagtcatttgtgacaggagcacaatgaaagggagcatctgcttgagggc

SEQ ID NO: 1121 - DNA, 79 bp, Homo sapiens
cggtccccagagggggcagctctaaccctaaacaagtgctcaacccttgaatgggcctggatggctcccctggggactg

SEQ ID NO: 1122 - DNA, 83 bp, Homo sapiens
caggtatgtaactgtggagacagcagcgctgcagaagaggcctcctgatcagaaagaatgtctgtcccacagttgactctctg

SEQ ID NO: 1123 - DNA, 74 bp, Homo sapiens
tgctttcaaagttatcatgaccatgaatcttactgcagcaagctacagattttcattataacaatttgtaagca

SEQ ID NO: 1124 - DNA, 71 bp, Homo sapiens
agaaaacattattttgaataaatgtgaattcgcaagtgccattaatcaaatttacaagatgattgttttct

SEQ ID NO: 1125 - DNA, 79 bp, Homo sapiens
gcaaaatttagtagagaaagtaaagttaaatatttaatgacataattaagtcttattaatggtatgttctttattttgc

SEQ ID NO: 1126 - DNA, 88 bp, Homo sapiens
tttctgcgaacttgattatatagcattttaaatacctgtgaacgttttaaggactcacagcgatgaattatttgcaggttcacaggaa

SEQ ID NO: 1127 - DNA, 84 bp, Homo sapiens
ccctctatttctgtgaacccagtaaaaatagcatggaataaaatttaattatgctatactgaatatttcatgtggaattaaggg

SEQ ID NO: 1128 - DNA, 73 bp, Homo sapiens
ggcatttcttcttgtgtttcctcttctcctcttctggggagggatgaaggagatcctttgcgagaggcatgtt

SEQ ID NO: 1129 - DNA, 89 bp, Homo sapiens
gaagtgtttgttaggcttcgcatgctggtctccatatgcctcttttcaattacatgtgccgccacaagtatggctaaacgaaacgcttc

SEQ ID NO: 1130 - DNA, 81 bp, Homo sapiens
tgcattaccaactatcctgtggaatatttcacataaaaggaagcaaaaaatgtgtgaatgtaaacaggctaattgtatgca

SEQ ID NO: 1131 - DNA, 74 bp, Homo sapiens
ggattaaagatgttggtcattttcttcccatcagctatgctgctgatggggagcactgacctcatgctttctcc

SEQ ID NO: 1132 - DNA, 77 bp, Homo sapiens
tattcttttgttttattgggctatttattctcttgacatccttggatgtgagttaatggaaccataataaaaggata

SEQ ID NO: 1133 - DNA, 71 bp, Homo sapiens
agaaaacaattttgaaagggttatattaaaggacattttctttgagattttaatttcatctttgttcttct

SEQ ID NO: 1134 - DNA, 87 bp, Homo sapiens
gagtgtgaactggctccagctgtgacaataaaacagcaggtggctgctgtcattaggggtggcagatgaggcaggggactaacattc

SEQ ID NO: 1135 - DNA, 82 bp, Homo sapiens
aatggctcgtccatggtgatttttatttggtttccttttatcatctggaggcacaaataggattttcccacatctagctatt

SEQ ID NO: 1136 - DNA, 86 bp, Homo sapiens
ctcaaacctggcatggtggtcacctttgctccagtcaatgttacaactgaagtgaagtctgttgaaatgcaccatgaagctttgag

SEQ ID NO: 1137 - DNA, 70 bp, Homo sapiens
tgaagaatttcttctggatgactgaccaagaggctattcaagatctctggcagtggaggaagtctcttta

SEQ ID NO: 1138 - DNA, 79 bp, Homo sapiens
aaatcaagcacagcaggaggtgttcgtctcccaggtaatgggtaaatgatgagcagatgagccatccttctattgattt

SEQ ID NO: 1139 - DNA, 71 bp, Homo sapiens
tttcaattacaaaagcctgtttgaacagcctctgtgacagcccatgttcaaataagcttttgtaattgaaa

SEQ ID NO: 1140 - DNA, 83 bp, Homo sapiens
tatgtgacagtgattgtgtacatgtagtttataattgaaatgattgttcagggttaacaaggctacacttcactgtcaacata

SEQ ID NO: 1141 - DNA, 80 bp, Homo sapiens
tcatcatacatttttagaactaagcagctgaatttattttctaatgaaaaaatctgtaagttttaattgtgctgtgagga

SEQ ID NO: 1142 - DNA, 80 bp, Homo sapiens
tggagaaagagaagctatgaaaagctagaaagaaaattgatttctgactacagctagatatcatacttgttttgacttca

SEQ ID NO: 1143 - DNA, 90 bp, Homo sapiens
gtaggaaacacagctaatggggcttagcaacagatggggagccagcacaaagctgtaggttcttcctctgcctcggctgtgacttcctgc

SEQ ID NO: 1144 - DNA, 76 bp, Homo sapiens
gccatggcaacttcatatttatccactttagctcctaattaaggggaaaagcatataacatattggatgtcaaggc

SEQ ID NO: 1145 - DNA, 80 bp, Homo sapiens
tggtaaataatttacatagttttgcattagctcaatttgcaaaaattgagcaaacagtgcaattttctgtaattatgcca

SEQ ID NO: 1146 - DNA, 76 bp, Homo sapiens
ggcagagtgctctgatattcttagatgaaaagtgccatataactttgaagaggaatattattaaatagcttctgcc

SEQ ID NO: 1147 - DNA, 86 bp, Homo sapiens
gggagtgttctatttcaattcaaagataattttaattcactaactcttagctagattaatggtcctactaaaaattaagcactccc

SEQ ID NO: 1148 - DNA, 89 bp, Homo sapiens
gatgtttggtgagggtcacatttgttttcttatgcattccttggcagtgctgccattatcagctaatagatggtcccttgtaaaatgtc

SEQ ID NO: 1149 - DNA, 84 bp, Homo sapiens
ttccatcactttacaccctagaaaactgatacagacttccccagttgaagtttaatacagaacataggtttatgaagtgtggaa

SEQ ID NO: 1150 - DNA, 78 bp, Homo sapiens
tgggaaccatttgtgtcgggtccagcatttgccatgcacaagatgccaggacctgaatgcttcaggatgaagttctca

SEQ ID NO: 1151 - DNA, 83 bp, Homo sapiens
gaagttcttctccttagggggcatttgcattttaatgggaatcttaaaaacccaaaggaaatgttctctaatggtgggatttc

SEQ ID NO: 1152 - DNA, 82 bp, Homo sapiens
gggagctttcataaaaggaccttagcatgctgagccctgattaaacatcagggagacatgatgattcttttgtatagctctc

SEQ ID NO: 1153 - DNA, 87 bp, Homo sapiens
tcattaatttatgcaaggtagcagccagcatattagttcacaccatttgtggattttgtttgctgtctcacatgcaaggtgaaatgg

SEQ ID NO: 1154 - DNA, 89 bp, Homo sapiens
tcctctcctgttgctgttggcagaaacatatatcttgtgtcattttgataaagttgtgcatttaatgttcctacagttaagtgagaggg

SEQ ID NO: 1155 - DNA, 76 bp, Homo sapiens
atgctagaaagcctcaactgttgatcaatggcaagtacatcagcttgtttaaaatatcatggggttctccaggcat

SEQ ID NO: 1156 - DNA, 87 bp, Homo sapiens
tccaatcaccttttatatcattactggattgctgtaagccataaggcctcagcattcctggatgatatctacctcaggatgactgga

SEQ ID NO: 1157 - DNA, 83 bp, Homo sapiens
cctgtaagcaaccataggcttgctctaacaatgctcatcaaaatagtgaagtctttgggatgtgcctatggttgtggtgaagg

SEQ ID NO: 1158 - DNA, 80 bp, Homo sapiens
tgttcctggaacacgacaaatctaaattaacctgaaatacaacagggatttcaggagttagatcacgagtccagagaaga

SEQ ID NO: 1159 - DNA, 80 bp, Homo sapiens
cattgtgttccatctttgtgttgaaatgcagatttcccactaaaaggcaaatccttcatttcaaaaggttgaataggatg

SEQ ID NO: 1160 - DNA, 72 bp, Homo sapiens
gcagttgtgcaacatgaaaactgcagtgacatgttaccatttgactgtctccgtagttcgtgatgcatctgt

SEQ ID NO: 1161 - DNA, 87 bp, Homo sapiens
ggactctaccattcttgatttagttttgagagaaaagggtttgcaaaaactataataatctcacagctggagatggctggaaagtcc

SEQ ID NO: 1162 - DNA, 76 bp, Homo sapiens
gatctcggacacatctgtggtgctgtccatggacaacagccgctccctggacatggacagcatcattgctgaggtc

SEQ ID NO: 1163 - DNA, 89 bp, Homo sapiens
tgccaagtttaaaacccacacaaaattgcagggttagagtctggaacaaaactccagcttcttggtgtggagtttttctacttatggca

SEQ ID NO: 1164 - DNA, 75 bp, Homo sapiens
taaattggcctttagcatatgttgctggcacagcagagaacctgcttccagggaaatatgtatggaggtatttta

SEQ ID NO: 1165 - DNA, 82 bp, Homo sapiens
tcatctcggggcctggtgaattaggacgacatcggcattttttattgctaaagacgtccagattgatccagcccttggctga

SEQ ID NO: 1166 - DNA, 74 bp, Homo sapiens
cgcagaaaccttctggaggtaaatctgcagaatggcatttttgtgagttctctgatagacctcgaggagctgtg

SEQ ID NO: 1167 - DNA, 76 bp, Homo sapiens
taatcattgatccaagagattccattgtagaacagctgtttaagccttctggaagacgtttttggaaatatgattg

SEQ ID NO: 1168 - DNA, 73 bp, Homo sapiens
gaagtgaaggcttaatgagcagagaaattaaagagtaaaactctgctagtgtcttcttaaatggcagcatttt

SEQ ID NO: 1169 - DNA, 85 bp, Homo sapiens
gccgaatgtagctgttggtgtatcaccatgggaaataaaaacttattatgttcattttgtatgtaacctagacagttgcatttgc

SEQ ID NO: 1170 - DNA, 85 bp, Homo sapiens
actgagggcaggtccaaagccttcagcacttgcagctcccacatcttggctgttgctgttttctttgggtctgcagcattcatgt

SEQ ID NO: 1171 - DNA, 74 bp, Homo sapiens
gccaggcagatttgctcactcaagaaaatctgtttttgcaggtttgctttgagttccaagatacagatcctggt

SEQ ID NO: 1172 - DNA, 74 bp, Homo sapiens
ggcctgtcttgggggtagctttgtggcctgaaaacaaatcatccttcacagcttgctcccaagtccaataagcc

SEQ ID NO: 1173 - DNA, 76 bp, Homo sapiens
cttaggggtgggggagccctgttagccctgtaaataaagtttaacgaggtgaacaatggctggctctgtccctgag

SEQ ID NO: 1174 - DNA, 81 bp, Homo sapiens
atcacctttccccctcccatgtgctttccttcatttgagatcttttgacctttggctttatttgggagggggaagggtgat

SEQ ID NO: 1175 - DNA, 85 bp, Homo sapiens
gataataccggcacctcttttcactctaatctcctacccgtctgagcaattcagcaggagataggggcattaaggccgtattatt

SEQ ID NO: 1176 - DNA, 83 bp, Homo sapiens
gtttaaaactagaagcagcagaaaactagcttgtaaaatgtatccaagtaaagtgcaggctaggctgtcttggggaaataaac

SEQ ID NO: 1177 - DNA, 72 bp, Homo sapiens
ggggagacagatggaacacagaaaggagagcaatgagttttatcctgctgtgtttccaatcagattttcccc

SEQ ID NO: 1178 - DNA, 81 bp, Homo sapiens
gaggggctgtagctcagggtgtgcactgcgaggctggacctgttgagtctgcagtggacatccatttagcttcaggttgtc

SEQ ID NO: 1179 - DNA, 76 bp, Homo sapiens
gcagctgattgcatttgatgagctgcaacattgtttcctcggtgtagattaggagtcagagcagtcaatgagctgt

SEQ ID NO: 1180 - DNA, 81 bp, Homo sapiens
tgctctaatccatagggattactgtggcagaatgtttcaacccactggagctttctggcacaagtaattttcatcagagca

SEQ ID NO: 1181 - DNA, 76 bp, Homo sapiens
ttcttccccactgaactttttctccaattcatgtactagccagatgtggattttctggaaagattcagttgaggaa

SEQ ID NO: 1182 - DNA, 82 bp, Homo sapiens
gatggatttccattttaatggatgtgtcagggcatcaaaatgtctctgttgtgttcagtcctcattaaaatggaagcccatt

SEQ ID NO: 1183 - DNA, 85 bp, Homo sapiens
gggattgatctgagggacacagagcccaggttccattaaagtgtattaatgccaaggtctgtgcaattagtgaaaagtcaattcc

SEQ ID NO: 1184 - DNA, 70 bp, Homo sapiens
gtttggtttttggaagctggcatggactagatttaacaaatcagctatgtggttccaaagttttacagac

SEQ ID NO: 1185 - DNA, 74 bp, Homo sapiens
gctttataaggcaatggatcatgttagcttaacttatatttaagatttgctggcctgatattattgtgttaggc

SEQ ID NO: 1186 - DNA, 89 bp, Homo sapiens
atacatgtgatttagcttgctgcaaattaaaaagacaagtcttaattaagataaaaatagtaaattgcctaaatattgaacacatgtat

SEQ ID NO: 1187 - DNA, 88 bp, Homo sapiens
ccttagagctaattagtttcttttcaagtaattgcaaatagtacattttccaggcccttggagtagaggctgacaactagctcgctgg

SEQ ID NO: 1188 - DNA, 73 bp, Homo sapiens
tcaaagttcttttctggtctgaggtagccaacaacggccacactcaggatttccccatagaagtgctctttga

SEQ ID NO: 1189 - DNA, 84 bp, Homo sapiens
ttatgtagaaattcaagaggtggattagagagcaattgtaatccaaagattgttttcagcaaagttcttttgaattatgcataa

SEQ ID NO: 1190 - DNA, 84 bp, Homo sapiens
gtggcgattgggcaggcttcatgcaggcagctggcgtctagggctgtcagacgcaatcagtgtttgcatggcacctgcggccac

SEQ ID NO: 1191 - DNA, 70 bp, Homo sapiens
tatttacatttgcttgccaagagaatggtaacattaatacagttgctccctttggccaggagtgtaaata

SEQ ID NO: 1192 - DNA, 89 bp, Homo sapiens
ctgtcatttaagttattccacatctcacccagctttttgacatgtctccaatagagatgtcagggtttgtggatttgatcttgtggcag

SEQ ID NO: 1193 - DNA, 70 bp, Homo sapiens
attaaattccatcaatgctgtttgttttggtgcccatttgggtattaataacaccgttgctgtttttaat

SEQ ID NO: 1194 - DNA, 85 bp, Homo sapiens
caacctgctgaacagttcctttttcagagacatagataccatccaaaaatttcctgatatccttgtttttaactgttgtgggttg

SEQ ID NO: 1195 - DNA, 86 bp, Homo sapiens
ggctgaagatatataaattacaatcagattatgtagataaaatacatgagctaaatttatctgctgtaaatacacttgtcacagcc

SEQ ID NO: 1196 - DNA, 74 bp, Homo sapiens
gagctttatcgctcgggccaggcggaggccgggcggccccgtggcttccggaggcgcccgggcgggatgagctc

SEQ ID NO: 1197 - DNA, 88 bp, Homo sapiens
aacatctgtttgaggctgggacacctggctgagcccagcacattatctggccctgggacagcttctgtctgagctcaggacatgtgtt

SEQ ID NO: 1198 - DNA, 82 bp, Homo sapiens
ggggcggggaggaattccggttctctgggactttccaaaaaaggcgaagatccggtgccggcggctccgcctccctagccct

SEQ ID NO: 1199 - DNA, 83 bp, Homo sapiens
atatgggttttgacatgggcatatctgtaggtctatcaaaaatatgataaggcagaaaaagctgcttgcattaagatccatgt

SEQ ID NO: 1200 - DNA, 78 bp, Homo sapiens
tttcctgtgctgaagccattcgccttccagcatcttcaatctaatagactgaagtgggctgaaatggctcttaggaga

SEQ ID NO: 1201 - DNA, 86 bp, Homo sapiens
catttcacatccatgaagtaggaattggggctctgcaccaggcgtttcttcttgtgtttcctcttctcctcttctggagagggatg

SEQ ID NO: 1202 - DNA, 90 bp, Homo sapiens
agcaaacactgagtgatgggtttcagatagcacttacattcatgacattaactttgtaagttatttaaagcttgtacacttaacattgct

SEQ ID NO: 1203 - DNA, 78 bp, Homo sapiens
agttataatatgcaaatgtctctggcatgtatgctcataaatgtgtttacaaatactccagggtggcatgtcttgact

SEQ ID NO: 1204 - DNA, 80 bp, Homo sapiens
gaggtgttggaaagtttaattagccagtgtttgtaatcttctttgaagctgaaaagtgctaattatgtttttcccacttt

SEQ ID NO: 1205 - DNA, 88 bp, Homo sapiens
agtgcttttctgtaacagtcatttgacatttaatataccataattgtattattaaatttaaatgcatatttgcaattctaaaagcact

SEQ ID NO: 1206 - DNA, 86 bp, Homo sapiens
tggtaaatcactgagatccaaactatataaattcctagctaaaactttagttaatgtctccatagtcagtgaccactcagtggcca

SEQ ID NO: 1207 - DNA, 79 bp, Homo sapiens
tatgcaggtgtaggataggtttatgtgaaacttctggaatcactgcaggagtggtatagacaatgaaaaaccctgcatg

SEQ ID NO: 1208 - DNA, 77 bp, Homo sapiens
cagatcaggtattgcttttgaagtgaacttgagaaacttatgaattttttatggttcactgcatgcaacatggtctg

SEQ ID NO: 1209 - DNA, 80 bp, Homo sapiens
ggctcttctcaattttacccttttagtcttgaaacatgaaatatcattttcttaggctgcccacgggactgagatgagct

SEQ ID NO: 1210 - DNA, 83 bp, Homo sapiens
ttattggcaatctcactgtcctccaaatgaaaactgcttccctgaaggcttttgatgtggagctgttcttttattgccaatag

SEQ ID NO: 1211 - DNA, 88 bp, Homo sapiens
ggcttgggctttgttggtcttccactgctctgctacatcatttgctaatggatcgtctggattgggagcacataacaaggcctgggtt

SEQ ID NO: 1212 - DNA, 88 bp, Homo sapiens
tgctatctcgcctcacacatcaacacacgtgccagacagattctgactgcaaagtctgttattggtgatgagagaggcagagagggca

SEQ ID NO: 1213 - DNA, 86 bp, Homo sapiens
gggcagattgcttctctccttctaattatgaatgttgcagttacaaaagaaactgtcattttgatagagcaaaagacaatctgtct

SEQ ID NO: 1214 - DNA, 83 bp, Homo sapiens
gttgtaaggtggaaacagagctttatttgtcttacttaaaatgatatatagagcacttgtctgtttattccactgcaaacagc

SEQ ID NO: 1215 - DNA, 76 bp, Homo sapiens
catgtcaggctcccgatgagtgtaattgtatactgattgtgtatagttttttaaacctcattattagccttgtatg

SEQ ID NO: 1216 - DNA, 79 bp, Homo sapiens
tgtcaaaagagaataatcctatgtcaaagtggcttagaagaacttttactcaggagcttacagaaattcctttttgaca

SEQ ID NO: 1217 - DNA, 79 bp, Homo sapiens
agcctgttccgtgctcgctaactataaactatctgatttatattcattaaccagtactagacagcggcaggcacaggct

SEQ ID NO: 1218 - DNA, 88 bp, Homo sapiens
gtaattatccagatttccttgctaaatgttattttatatattatgtttaatagcctctttcttttggctatggaaggatggtaatagc

SEQ ID NO: 1219 - DNA, 77 bp, Homo sapiens
tccagaggtgtataggccaacattgctccaattcgtacaagtaatctcaggagatgtggcactccatacacctggga

SEQ ID NO: 1220 - DNA, 85 bp, Homo sapiens
taaggatttttgataattaggtagtatcttctataatgtatattcattatagtaattatgaaatccctagtacaaatctgcttta

SEQ ID NO: 1221 - DNA, 84 bp, Homo sapiens
cttggcacgaaacatgccactgtttccatgggcctgagttacctttccccagattgctctggttttgttttgtttgcagccagg

SEQ ID NO: 1222 - DNA, 89 bp, Homo sapiens
gaccatcatcttgaacttgagtctaaagagtaaagtcctagggccatacttagagctttaaagacacattttaaaattgatggtgagtc

SEQ ID NO: 1223 - DNA, 83 bp, Homo sapiens
tttgcaggactgtgtgcctaataagctttctgtttaaaatcctaacactgagctttctaagagcgacgtggtctacatgtaaa

SEQ ID NO: 1224 - DNA, 82 bp, Homo sapiens
catgggaaatgagtgccaggcttttctttctatttagtaatttatcaagggaagaggcgcattaataaacatatttcccatg

SEQ ID NO: 1225 - DNA, 85 bp, Homo sapiens
ggtgtctgtgttcaactaagtaaatatttctatggtgatagtatacacaatacaatggccattatttaatgttaatacaagtacc

SEQ ID NO: 1226 - DNA, 90 bp, Homo sapiens
ccagctctgagaagtgggctcagggactacaaaatcaaatattattattaatcactgtaattacttttcttggcccaactgtggagctgg

SEQ ID NO: 1227 - DNA, 89 bp, Homo sapiens
gagacctttggcaattgtgatattgtgagaatttccattcgataaagataatggaatttttaaagtacttcttggttgctattaggtcc

SEQ ID NO: 1228 - DNA, 80 bp, Homo sapiens
tgtttttgggaaaggttttacgatgtgattttatttgtttgctagtaaaatttattaccgtaatacttttaccatcctca

SEQ ID NO: 1229 - DNA, 88 bp, Homo sapiens
tgctggaagggtctgaaggcccagtatctcgccttattacacctgtagttatgagcagtaactatggcctttattacaacattcagca

SEQ ID NO: 1230 - DNA, 72 bp, Homo sapiens
tctcaggtctgggaaatcagattgtctcatttaaatttaatttaaatttctgtttgaagaatcaacctgaga

SEQ ID NO: 1231 - DNA, 73 bp, Homo sapiens
tgctgtctggaatgaactgaaatagtgtttggtttgtgtaattacgtccatctatctttatattccagcggca

SEQ ID NO: 1232 - DNA, 81 bp, Homo sapiens
cctggatgctgtttcattatgtagagtcaggcaaaagacagacggatgtgtgtgtgaggcggcgatgaagctggcaccagg

SEQ ID NO: 1233 - DNA, 74 bp, Homo sapiens
gagattagcgaaagggattctggccaaatccctgatcaagttgcttggcacagaattattgattggcaaatctt

SEQ ID NO: 1234 - DNA, 85 bp, Homo sapiens
ggctttatttaaatggatttgatgggtctcttggttggcttgacaaccagagggaaaaattaatgttctgcatttaatctcagct

SEQ ID NO: 1235 - DNA, 88 bp, Homo sapiens
gtgttgatttcttctttactaaaatatattttcattatttttgaagtaatgaaaacatatctatttttgtttagttagctgacaacac

SEQ ID NO: 1236 - DNA, 80 bp, Homo sapiens
tatgatatttacttagaaatgaaaattgattgcctttaacttacgataagataattatgttcctctgagtcattgtcatg

SEQ ID NO: 1237 - DNA, 88 bp, Homo sapiens
gttgatggatgtctttccctggggagttggggcactgctgagatgcagtttttccagcaattggtaaaatggaaagataattcaaggc

SEQ ID NO: 1238 - DNA, 89 bp, Homo sapiens
catcccatggtgtgcccccaaacatcttatttgtcttgatatttctttcacagaaatacatatgacagataaggagtcactagaggatg

SEQ ID NO: 1239 - DNA, 80 bp, Homo sapiens
ggatctccaaatatcatttacataccatatgccctgaattacctaggcacaatggctgtggataaatatgtttcaggtct

SEQ ID NO: 1240 - DNA, 84 bp, Homo sapiens
catggcctgtgcttttcagctgctcttacgatttagctacaagtattttaaatcccagctgtcagctcataagcactgaccgtg

SEQ ID NO: 1241 - DNA, 75 bp, Homo sapiens
cactctgaagttagatttcacagaaagtttagattctcctttctttcttgaactcagtgaaattcttcagcagtg

SEQ ID NO: 1242 - DNA, 81 bp, Homo sapiens
atggttggaaactgaggtgagcaggcatttagtaattgttcagtggtctgtaaaatgaatttctgatctcagtccagtcat

SEQ ID NO: 1243 - DNA, 82 bp, Homo sapiens
ggttttgtacatacagaaactgcatggtatttaaattattgtttgtctctgatgatgtatgcagtttctttaaaaacaaacc

SEQ ID NO: 1244 - DNA, 90 bp, Homo sapiens
ctctccgtgcttctcggcccgccgcccttcctgtctcggggacacggtttctaaataaggttgggagggtgagagggcgggaggggagag

SEQ ID NO: 1245 - DNA, 83 bp, Homo sapiens
cctaagagataatggatgtgaaaatcctctatagactctagagtggaatatgaatgtaggggattattgctattatttctagg

SEQ ID NO: 1246 - DNA, 83 bp, Homo sapiens
acagtaggtatagctggcatgggactggtagtgcaggctggctcttggaaaggagtatgtattccaggctggttggctgctgt

SEQ ID NO: 1247 - DNA, 73 bp, Homo sapiens
gagtggctaattagctaaatgaattaattgacatccatacatgcaattagcaaatggttataagcagctattc

SEQ ID NO: 1248 - DNA, 85 bp, Homo sapiens
ttttcccagagaatgcctttcagaattgctgttgaattacaaagaagtatttattgtttgaggtgattaatgattcctgggaaaa

SEQ ID NO: 1249 - DNA, 89 bp, Homo sapiens
ctgtagctttttgtactttgtggtttctctcatcctgttacattaaccataacatggaaaggggcatgatcagaaggtacatgtcccag

SEQ ID NO: 1250 - DNA, 81 bp, Homo sapiens
ccggtcttaatcagtggtggaagaatggtctcagaactgtttgtttcaattggccatttaagtttagtagtaaaagactgg

SEQ ID NO: 1251 - DNA, 79 bp, Homo sapiens
gcaggtgacatcggagaaacatgagtgaatgtgatttcgaacattctgaatttcttcatgttgatgttccttcacctgc

SEQ ID NO: 1252 - DNA, 74 bp, Homo sapiens
ccctaggaagtttattaaaaatgctaaatcaggagctgatggcagcttaaatagcttgaagtaacactctaggg

SEQ ID NO: 1253 - DNA, 75 bp, Homo sapiens
tgtggcagttttaagttattagtttttaaaatcagtactttttactggaaacaacttgaccaaaaatttgtcaca

SEQ ID NO: 1254 - DNA, 75 bp, Homo sapiens
tctagaacttttattaagtaggtacacttgacagtattgaggtcatttgtcatggtgctatttaattagtctagg

SEQ ID NO: 1255 - DNA, 75 bp, Homo sapiens
tttacttttcctgggagagtgtgatttaagggctaatcagcaccatggtccttgcacattatctgggaaagtaga

SEQ ID NO: 1256 - DNA, 83 bp, Homo sapiens
gccactgccagggcccgggcaaagtgagcatcagcgaggaaggagccatcggaggagctgacaaggctggctctggcgctggc

SEQ ID NO: 1257 - DNA, 70 bp, Homo sapiens
actagcattttgttttggaaaatagttcttccatcgtgtggaatatttttcaatgcagtaagtagcaagt

SEQ ID NO: 1258 - DNA, 80 bp, Homo sapiens
acagcatgcttggacgccacagttcttcaaagtctgatttctcttcagcttttaagagtctttggtttcggggttcctgt

SEQ ID NO: 1259 - DNA, 71 bp, Homo sapiens
gtggtctgtgtgtctgagtcagagagagcctacaacagggttctttgaattgatggctcactcccagccac

SEQ ID NO: 1260 - DNA, 82 bp, Homo sapiens
ggtgcgcgcggtggacgccgattcgggctacaatgcgtggctttcgtatgaattgcagctggcggcggtcggcgcgcgcatc

SEQ ID NO: 1261 - DNA, 77 bp, Homo sapiens
cagcctccccacagtgcggtctttctctgctttctcactaggaagagagaatgaaaggacaggacaaaggagggctg

SEQ ID NO: 1262 - DNA, 73 bp, Homo sapiens
gctcttcaaagcagcagaaagctggcccctggggtaattagcagagggcctattctttgctgcttgggacagt

SEQ ID NO: 1263 - DNA, 87 bp, Homo sapiens
gggtgaattaacactagaagagaaacacagctggcaaattgacagtagcattgttaaacagttcatttcttctgttctgaggcacct

SEQ ID NO: 1264 - DNA, 79 bp, Homo sapiens
agcctgcacccagggagcggcaggggagtgacacagtgagtcacagaccacaacaaagcccttcctggcatgtcgggct

SEQ ID NO: 1265 - DNA, 74 bp, Homo sapiens
atgttaatatctactaaaaagtaaaactgaaaaccttttcttttttaagatttgcttgagagatggagtaacat

SEQ ID NO: 1266 - DNA, 78 bp, Homo sapiens
ttttgctacacatcagcaagtccttgaggagagcctgctggctccaaaggcctgaagtttgctgttgaaatagcagag

SEQ ID NO: 1267 - DNA, 71 bp, Homo sapiens
atttaatgtaatttccctaaaatggaggtaataggtactcagggaatacacctccagggtttacatcaaat

SEQ ID NO: 1268 - DNA, 76 bp, Homo sapiens
gctgaagtgattccccgcaggcctgtttgttgttgtgcccggtgccgaatcacttgcaggctgaatcacttacagc

SEQ ID NO: 1269 - DNA, 87 bp, Homo sapiens
gttcatttgtctttattatgattccatgattacttctggttagaacactagtatttttgagaattgtaatgttagtgatgaatggcc

SEQ ID NO: 1270 - DNA, 86 bp, Homo sapiens
ttggactaaatcatggcaattagtgtaacggaaatgtttacagcaatctctgatggcagttctactaatgcaatgatttagctcaa

SEQ ID NO: 1271 - DNA, 74 bp, Homo sapiens
tgcctgttgggataggaggagttaattaaattactttatatttagtgttaatttggtcctaggcttgtcaggta

SEQ ID NO: 1272 - DNA, 79 bp, Homo sapiens
ggggctgccatcctgctgtccgtcatctgtgtggtgctggtcacggccttcaatgactggagcaaggagaagcagttcc

SEQ ID NO: 1273 - DNA, 81 bp, Homo sapiens
gctgcaggaccagtaaccaatgaaagatgacttctggctgccctggagagggggcagggttcagaatcaggttctgctagc

SEQ ID NO: 1274 - DNA, 86 bp, Homo sapiens
aaatatttatgtactcaaattataaatctagtaaagatggcatttcaccttatactagttatttattaataatgagagctgtattt

SEQ ID NO: 1275 - DNA, 78 bp, Homo sapiens
cctaaactaattgcataaattcctttaggccactcagagctgctctctgggttgggatctgatcaattagtcattagg

SEQ ID NO: 1276 - DNA, 83 bp, Homo sapiens
cttcagatacttatggagaacatgggaattttaaattcacaattcagtgcaagatttaaaatgatcttcattagaatttgaag

SEQ ID NO: 1277 - DNA, 75 bp, Homo sapiens
agaggggtgactgcggggcttgttgcgctgaagatttacaatgtacttcttgcaggcggctcagcaaccccctct

SEQ ID NO: 1278 - DNA, 84 bp, Homo sapiens
ttcttccttttaatgaatgagctttcgctgttaatgaggaataatcgtttggctaatgagctttgaaacattaagagaaaagag

SEQ ID NO: 1279 - DNA, 78 bp, Homo sapiens
gggagcaagtataactaaaacatgtgccttgcaaagagggcaaagctgcaatttgccaagtgcactataattgcttct

SEQ ID NO: 1280 - DNA, 73 bp, Homo sapiens
aatgtcatgtatttacataattagcataattacatataagtgcataattggtgtaaatatatgtaattacatt

SEQ ID NO: 1281 - DNA, 86 bp, Homo sapiens
ttggtagacataaattaagggccctttcacatatgcattagaaatactgctgtgactgaaatatgcataaagtctgtgtctattag

SEQ ID NO: 1282 - DNA, 84 bp, Homo sapiens
gcttaaaaaacaatgaagttaatttttaaaaacctttcattgagttccatgagacccctattaattttattgtttcaataaagc

SEQ ID NO: 1283 - DNA, 79 bp, Homo sapiens
atggatttctaattcgatttgttgggctgggacccaatttggtttgataagcctttagaaaggaattttagggatttat

SEQ ID NO: 1284 - DNA, 77 bp, Homo sapiens
catgcattaaatttttgttccagattattcacggtttgttaattggtgtgatagttgatgaatattgatggtgcgtg

SEQ ID NO: 1285 - DNA, 82 bp, Homo sapiens
gggcaggcgtcctgcgggctccaggcttctctgccacagctggcggaggtgcttaaggccttggaccccgtgacctttgccc

SEQ ID NO: 1286 - DNA, 75 bp, Homo sapiens
gctgcgtgaccttaatcactttagctttccatgccttatggaaaagttaaagtttccatgaaaatgtcatgtggt

SEQ ID NO: 1287 - DNA, 86 bp, Homo sapiens
cagctggcctggtgccctggtgcgtggaggtgtagctgggctctgacccagctcctcaaacaggttccatatggccctcccggctg

SEQ ID NO: 1288 - DNA, 77 bp, Homo sapiens
ccaattctcacttaggtgttagggatttaatgatactcctctgaagagtatttttactacctgagggtggggaatgg

SEQ ID NO: 1289 - DNA, 71 bp, Homo sapiens
ggtgcagtgagaagcaggtgcggtgacacgtgtcctcccggtccatgagcacctggtgaatctcctgcacc

SEQ ID NO: 1290 - DNA, 86 bp, Homo sapiens
gctgtcacggccgctgacaaatagttccctttgcttcctgatttggaactgcgcgccggcgagaagttgttagtggcttggatggt

SEQ ID NO: 1291 - DNA, 72 bp, Homo sapiens
tctattctgggttgcttaatgtactagtgccagctctgtgccactagacatatatttagcatattggaagga

SEQ ID NO: 1292 - DNA, 85 bp, Homo sapiens
ctttcatttgttaatatatgcaagttgaaaatgaaaataaaaacatgttttacttcagctgctccctatgttataaaatagaaag

SEQ ID NO: 1293 - DNA, 73 bp, Homo sapiens
gggagggggtggccctgagcttataagggtctctaagagccaggagacagtcagcctggctacctctaatctc

SEQ ID NO: 1294 - DNA, 79 bp, Homo sapiens
gtgttctgaatattaaaatagaattgggtgtggagttctgtcttggacctcatccaaatgattctaattatcaaggcat

SEQ ID NO: 1295 - DNA, 70 bp, Homo sapiens
agctgttaaatgtccattagcctaatatatggcttataatatcttagctaactgcatattaaaaacagct

SEQ ID NO: 1296 - DNA, 74 bp, Homo sapiens
gaggctgcacaggagagtctcagggaccccccaggctgtaccaagcctcccccagactccaccagctgcacctc

SEQ ID NO: 1297 - DNA, 71 bp, Homo sapiens
gacctggttaatgtgagacaattaatacaatccatttttatgcagattaaaacgtttcaaattaacaggtc

SEQ ID NO: 1298 - DNA, 70 bp, Homo sapiens
gaagaagatgctgcttgttcacgggcatttttattacattaggatctctgagctcgtgcagtacttcttc

SEQ ID NO: 1299 - DNA, 76 bp, Homo sapiens
gtcatgatgttgcgtcaccacgtgatgacgctgtgccatcacaacacatcatcgcatattgacacaatgtcatggc

SEQ ID NO: 1300 - DNA, 68 bp, Homo sapiens
attggcatgtcttttcctgctgatttattggttaattccaacaattcattgtagaaaaggccaccaat

SEQ ID NO: 1301 - DNA, 86 bp, Homo sapiens
agcctaattgggtttacttgtgccttggcttaaggtctagaatataataaacttaaaggtctgaacacagtgaggttaattatgct

SEQ ID NO: 1302 - DNA, 84 bp, Homo sapiens
ggctcccactttgtctccagtcttgatcagctgcacatcactcaggatttcagtggcgcccctggagattttagtggtgatgcc

SEQ ID NO: 1303 - DNA, 82 bp, Homo sapiens
atattgtactgtagtaattttgtatttacatttgtatgatgtgacataatagatgtgaatgttaatcactgcttgactatgt

SEQ ID NO: 1304 - DNA, 79 bp, Homo sapiens
catttgttttcagtgtgtttatgcagcttaattgtctcatcaggcactttcccaacataattatgctttttaacaaatg

SEQ ID NO: 1305 - DNA, 88 bp, Homo sapiens
gacatagataatttttgaattctgatagaatacaagtgtggtaaatgccatgtttgtactttatctaacatcttctctttcagtagtc

SEQ ID NO: 1306 - DNA, 80 bp, Homo sapiens
ttaggtgttaaagtttctgttgtgctgcaatctattttcttcacagagatttggaagaagcaagcagaaattgaacttga

SEQ ID NO: 1307 - DNA, 88 bp, Homo sapiens
gatgagctttgtgtccataaacctttgaatacttatagaggaactaatcttcctgtctgagattttctgaggttcaacacatctcatt

SEQ ID NO: 1308 - DNA, 75 bp, Homo sapiens
tcacgacaagcctctgggattactgaaggtcatacagctggtaagtggtgattaattgtcagaggagtggtgtga

SEQ ID NO: 1309 - DNA, 87 bp, Homo sapiens
attattcacccactcaactctaatggcacttaatactaatgagtaatctagtggcaggtgccaggattgaggctttggttggataat

SEQ ID NO: 1310 - DNA, 82 bp, Homo sapiens
gctgaattaagtcccttgagatacacagatgtggtttaacttagttataacatcttgtcatctagtggcgacaaagtccagc

SEQ ID NO: 1311 - DNA, 86 bp, Homo sapiens
catgtggggaggtaaataatcatttctgttatgtcagtggaaaattttctggagatcataaagaaatcagtttaccctgaagcatg

SEQ ID NO: 1312 - DNA, 88 bp, Homo sapiens
ggctgatctcttctgacatttatctccgctcgtgagaggagatggaacagctcactcatgaagatgaatgtcatacaagagctctgcc

SEQ ID NO: 1313 - DNA, 74 bp, Homo sapiens
cctcatcagagacctccctgagccagcaaagtcaaggctgtgagctcagggccttcagaaggtcactggagagg

SEQ ID NO: 1314 - DNA, 73 bp, Homo sapiens
ttccttatgaggataaatagccgaagcacattgaggttaatattgcttttaagctatttgtctccatttggga

SEQ ID NO: 1315 - DNA, 82 bp, Homo sapiens
tgcttccaagtcctgctatttggatttgattttttaaagtacttcctttattttaattcagaccccagggacctggagagta

SEQ ID NO: 1316 - DNA, 75 bp, Homo sapiens
ttccttaaaatcaacataaaaaccttgcgaactatttcatgccaggtttgacaggtggtgatagtgtttgaggag

SEQ ID NO: 1317 - DNA, 78 bp, Homo sapiens
tgaagattcccttctatgtatttatatcatgagctggacttcatacttttgaaataattaatggaaggcatattttta

SEQ ID NO: 1318 - DNA, 76 bp, Homo sapiens
gatgaggaagatgtagtccacggggatggaggacacgaagtccaccatgaaccacgtgcgcacgtacttcttgatc

SEQ ID NO: 1319 - DNA, 90 bp, Homo sapiens
tagctttttacagagtgctaacaatgctcgtctcactgaggtcatcacaccctggtgagttaaaagagctacttcattcctgctgagcta

SEQ ID NO: 1320 - DNA, 79 bp, Homo sapiens
tctgtgaatgtgtgattaataatgccagtcaattgaatcttgtaagcagttcagaatgttgttaattacagttcaggga

SEQ ID NO: 1321 - DNA, 73 bp, Homo sapiens
cattgtctgaattactgaagctcaactcatctgataaaataggtgagctttgtggtaatgaagtcagataatg

SEQ ID NO: 1322 - DNA, 84 bp, Homo sapiens
tgtggatgataaaactttaattaaagtggtgattagaaacagaataataatgaccactaataaagtagtttatagaaatcgaca

SEQ ID NO: 1323 - DNA, 81 bp, Homo sapiens
ccgcgaggaccttctggaggtaaatctgcagaatggcattttgtttgtgaattctcggatcgaccgcgaggagctgtgcgg

SEQ ID NO: 1324 - DNA, 83 bp, Homo sapiens
atggggatgttaaagctttctctttgcaactaattatggcctgatttataggcctggccttggtttgatagagctctcctcat

SEQ ID NO: 1325 - DNA, 77 bp, Homo sapiens
tgacttttcatccccttcacaccctctgcatttcccttttggagagctcagagggaggtgaagtgggaagaaaatca

SEQ ID NO: 1326 - DNA, 72 bp, Homo sapiens
tggcgctagctcggaagctgccgaggtgctaggagttgccgaagcaagtccggaagctaccgagcgagtccg

SEQ ID NO: 1327 - DNA, 76 bp, Homo sapiens
tatgtcagctttgcatatttgtaaggttcaagggtttattgccctggcctgaccttgccaagtcagagttaacatg

SEQ ID NO: 1328 - DNA, 73 bp, Homo sapiens
tagtttgtgcaaatagtgggtctttgtgtgtttgaactcccaccacataagggcaaactcaatatgcatgcta

SEQ ID NO: 1329 - DNA, 90 bp, Homo sapiens
gtgactgtcatccttctggttataattactcatagatcttgcaaaagtagcagagatgcatctattataaccatcagtcaggatggtcat

SEQ ID NO: 1330 - DNA, 79 bp, Homo sapiens
tacattgcggcaattgacattttcctgaaattcatacgtctcttcccagactcattaaatgtcctatgttgctaatgta

SEQ ID NO: 1331 - DNA, 77 bp, Homo sapiens
gagctgcaagtaaattgaagatacaaattatgttgtaaagtgaaatattttgtgttattcgcgttattctgcagttt

SEQ ID NO: 1332 - DNA, 89 bp, Homo sapiens
acagacatccagtctaattacaggtgtctttttaaccagtgagaggaaactgggggaagatagattcttgtttttaatctgctatctgt

SEQ ID NO: 1333 - DNA, 84 bp, Homo sapiens
tctccagttggcttcttgtgattggccagaacttttcctcactggagagatgaggagaatccagtcctccaaccagctgagaga

SEQ ID NO: 1334 - DNA, 75 bp, Homo sapiens
tacatgtgactatcgtccaatttgctttcttttgtagtgacattaaatttggctataaaagatggactacatgtg

SEQ ID NO: 1335 - DNA, 83 bp, Homo sapiens
agtacagatagaggtagtaacattttgccatctggcaaagccactagaccagatggattcattaatgacttctctaaagtatt

SEQ ID NO: 1336 - DNA, 71 bp, Homo sapiens
ccagccctcagctgcagctggggaggggctgaagggtagggagccctatcccacctgcatcagaggcctgg

SEQ ID NO: 1337 - DNA, 80 bp, Homo sapiens
agaggtaatgtgaatatttaatgttgtgaatccataaatatttaactacattcaaatatttagctactaaaattgcctct

SEQ ID NO: 1338 - DNA, 70 bp, Homo sapiens
gtttccttttctgtgtgcagctcccccagcagagctgggtagtttcctggaggtgccaagagaggttagc

SEQ ID NO: 1339 - DNA, 90 bp, Homo sapiens
agtaattgtcactctggcttctcaaggtttgtcaggcacccgaatgggattatgacatagatctgaagggtatttcatgtgacttttact

SEQ ID NO: 1340 - DNA, 87 bp, Homo sapiens
tgggagcaggtattgcattttcctcccgcttcattcctgatcagagattattcatttatgaatgggtggctgtaaaaacttgcctca

SEQ ID NO: 1341 - DNA, 75 bp, Homo sapiens
gatgccgggcgcccgccgcagccgctgccgccggagcccgggatggggcgagaggctgcggcggacgccagcatc

SEQ ID NO: 1342 - DNA, 82 bp, Homo sapiens
cctgtccctggcactgtgccttcacactggtcactgtgaaaagcagatcacactggactcagaggccagaatccaggacaag

SEQ ID NO: 1343 - DNA, 81 bp, Homo sapiens
ttacaggcaatccagtcactatggcaggaaaagtaattaccaaactgccacttcctgcaaacagcaagattgtcgctgtaa

SEQ ID NO: 1344 - DNA, 86 bp, Homo sapiens
gccacattctgaaagtgatctttttgaaacgaggattgcaaatagctgcagcttctcaaaactgcaattgcttttcatggtgtggc

SEQ ID NO: 1345 - DNA, 81 bp, Homo sapiens
gttatccgggacgtcttcacagtgaacaaagctgcccatgtgcagcagatgaaaacagtgaagcagagtgtactggatggc

SEQ ID NO: 1346 - DNA, 73 bp, Homo sapiens
gtcaggctgctgtattctcttacacagatgccagtaagaacaaaggcatcacgtggggagaggataccctgat

SEQ ID NO: 1347 - DNA, 75 bp, Homo sapiens
cctccccaagcaatctgctcacccacttgttgtcatggtgactctggctgggggtgtggggactgagtggggagg

SEQ ID NO: 1348 - DNA, 70 bp, Homo sapiens
aagagcacaaacctttcattttgccgtttatttgtcttgtggccggtacagtgaaaatgtattggctttt

SEQ ID NO: 1349 - DNA, 85 bp, Homo sapiens
taattcaacttctcccctgacttaggccacattgtttcaaagcatgtggtataaactactgaccactggggaattgcttgaatta

SEQ ID NO: 1350 - DNA, 75 bp, Homo sapiens
agtgtcattaaataaagggatagctctgctcagcacttctgttgcccccatgttgaatccctttatttatacact

SEQ ID NO: 1351 - DNA, 80 bp, Homo sapiens
ttgatgggcaaggaccgctcatacagcggcgtgtgcttcccttcgtgaggaatgttgctgtagctgttctgctccgtcag

SEQ ID NO: 1352 - DNA, 85 bp, Homo sapiens
gctatgctcagctgccaccctgaaatttatggatgccggtggtgacctggcaacagtaaatttcaaggctagttaagaggatggt

SEQ ID NO: 1353 - DNA, 76 bp, Homo sapiens
tccagagaaaatagattcttttccaattcagtcaactgtactgagctggaaagcgagaaatgttatttttccagga

SEQ ID NO: 1354 - DNA, 78 bp, Homo sapiens
tccctgcttttatttgtagcttcccaaagcttttgctggtaataaaaggattgtaaagttgacaaatataagcaggga

SEQ ID NO: 1355 - DNA, 90 bp, Homo sapiens
atagcatgcccatctcccagagtgtcacaaactctttacaacaagaaatggaatagaaagacgatgctttgcagacttgggtatagttat

SEQ ID NO: 1356 - DNA, 87 bp, Homo sapiens
gtttcaagtcgtttgaccatgttctagtctgagctaattttgtaagtcaaattgcttaagaatgaatatgaaatctttgactgaagc

SEQ ID NO: 1357 - DNA, 76 bp, Homo sapiens
taggtgacagagagaatgtagcacaattgagactaagtttggtaattttgtgctgtttagtttctttatttacttg

SEQ ID NO: 1358 - DNA, 87 bp, Homo sapiens
tgcatggccttggcctcggatgccagaaattaatgctttactctttagcattcgtcacctttggctctgaacagaaaggcaaatgca

SEQ ID NO: 1359 - DNA, 85 bp, Homo sapiens
gtagcatcaaaggcagcatttctatttccaaacagaagaaaataaccttataatgaggagtcatagagagaactgaagatgctgc

SEQ ID NO: 1360 - DNA, 87 bp, Homo sapiens
ccaaggcactgttgtgctccttaaaattgtaaattatgtctgtttaagaaaatgtcagtgttttttaaaacagaataacagtgctgg

SEQ ID NO: 1361 - DNA, 86 bp, Homo sapiens
ggtttaagttgcatattgtgtttttagccagattttgctgataaatgctatcagcaagactgaaatgaaatacagcaggttaagct

SEQ ID NO: 1362 - DNA, 80 bp, Homo sapiens
ggggccagggatagtcggagatgggcagggcgggggccccactggcgaggggccctcggcttctggggtccctgagcccc

SEQ ID NO: 1363 - DNA, 88 bp, Homo sapiens
cgtgtacctgatcatcgccatctgcgcggtgtccagcctgctggtgctcacactgctgctgtacacggcgctgcggtgctcagtgccg

SEQ ID NO: 1364 - DNA, 84 bp, Homo sapiens
ttctctttcatattttaaaaattggaattaatatgctctttcagaatagttcaatttaattactactttaaaattcaaagagaa

SEQ ID NO: 1365 - DNA, 71 bp, Homo sapiens
aatagctggaaaaatgaacagattgttctgggaggtcgtctttccaatttgttcctagttttcagtctgtt

SEQ ID NO: 1366 - DNA, 83 bp, Homo sapiens
agaaggcattagagctaaatcatcatttatgtttgtcacaggggttgcaaatgtataatgagattccagagttaatgttttgt

SEQ ID NO: 1367 - DNA, 90 bp, Homo sapiens
gtggtgcacttaacttgtggaatttttatactaaaaatgtagaataaagactattttgaagatttgaataaagtgatgaagttgcattac

SEQ ID NO: 1368 - DNA, 76 bp, Homo sapiens
ggaggcaggtctgactgagttaaaggctgaaggacttaatcctttgaagaaattttgatttagttttattacctct

SEQ ID NO: 1369 - DNA, 82 bp, Homo sapiens
gattctattattccatttttaaacctgtggagtgggagtgtttctgagtaccctgctcacacagatggtggtgggaagaatc

SEQ ID NO: 1370 - DNA, 75 bp, Homo sapiens
cggtggagggaaaggggaaaggagccattttctgctgcacatcagtcagtgcctgcgccctccctccctccgccg

SEQ ID NO: 1371 - DNA, 80 bp, Homo sapiens
aggaggccctgagtgctagtagccacttatagaaagtcgcttccagcaattcttctaggagtggagcctcagggctgcct

SEQ ID NO: 1372 - DNA, 84 bp, Homo sapiens
caaatcaagcagctattcactcagatttattggcataaccaggtgagacagccaaaaatctccaagagtgggttgttgattatg

SEQ ID NO: 1373 - DNA, 83 bp, Homo sapiens
ttcaacaccccagccatgtatgtggccatccaggccttgctgtccctgtaagcctctggccataccactggcatcgtgatgga

SEQ ID NO: 1374 - DNA, 76 bp, Homo sapiens
tccagttggcctggtgaccgtaaccgttttagcaacagtggtagttgttgaggtggttaccatagtgctaacttga

SEQ ID NO: 1375 - DNA, 73 bp, Homo sapiens
tggttgtgttggggcatgggagacaggtgcacctgcagaaggaatttgcctgcttctcatgccaccacaccca

SEQ ID NO: 1376 - DNA, 84 bp, Homo sapiens
gctggggctggtgagatgttgggcacagtagacaatggtaccagcgaggggcctgtcttctgagtccagctggcagcaggcagc

SEQ ID NO: 1377 - DNA, 87 bp, Homo sapiens
gagagattgtatcagtgctgattttcatttaaatggatggctatgagattttttaaagcatgccaaaaatctgtttgtacatctctc

SEQ ID NO: 1378 - DNA, 73 bp, Homo sapiens
attgtaaaactaatagggctgttaaaaccagctttcctgaaaattatgaattggtagccctgtttcttataat

SEQ ID NO: 1379 - DNA, 81 bp, Homo sapiens
ccttacaaggctgtttttctaacagcagaacattggcaataaatgtctattagtcaaaatcactgcagcagttttataagg

SEQ ID NO: 1380 - DNA, 86 bp, Homo sapiens
ggagactgggaagttgctgtgctgcataaccatgcaacactcgagagtagctggtttcattctgtagcctgacttcccggttcttc

SEQ ID NO: 1381 - DNA, 81 bp, Homo sapiens
gttttcatgaaatggaagcatctgctgaaattatttgaggtgtcccatcactaattaaaagagctttcatttatagaggat

SEQ ID NO: 1382 - DNA, 85 bp, Homo sapiens
cagcaaatgtgaaagaaaggacacacgtaggtactgtcatttaggtaatgtcatctatgatcagtttttgtttcattttttgctg

SEQ ID NO: 1383 - DNA, 81 bp, Homo sapiens
gctcagtcacatgtcaaatagataatgaataaatgcatcgccaatgcactctattcatttatttttgacaagtgagttggt

SEQ ID NO: 1384 - DNA, 87 bp, Homo sapiens
gggaaagcccagctgttaaagttttagaatcaggaataagaacacatttttattagatccttcatcttgtctacagtgggttttctt

SEQ ID NO: 1385 - DNA, 82 bp, Homo sapiens
gccaccatctttggctggaggtttccatcctagtgagatgcttgacttcgttttatctttaacttctgggcaagaaggtggc

SEQ ID NO: 1386 - DNA, 88 bp, Homo sapiens
tatttgtatatttctattgatgtaatagcttgcaagaaaaagagctcatgtctctgcctgaaggtgaaatcttatgaatatgcaaata

SEQ ID NO: 1387 - DNA, 73 bp, Homo sapiens
tatagagttctttaatggctatgcatagaattattctggatacttcatggagcatagcaagtgaagttttatg

SEQ ID NO: 1388 - DNA, 77 bp, Homo sapiens
gttgggggccaaggcgtgctggagactttggggtctgccaggctttcactctctccagatcgcccctgcctcccagc

SEQ ID NO: 1389 - DNA, 88 bp, Homo sapiens
tttatgaaacatttgtgtctaaatagaaaatgtgcttgagaaattctagcccaacatgcaatttagagagaaagttataaatcataaa

SEQ ID NO: 1390 - DNA, 71 bp, Homo sapiens
ctgtgatttgaaattgctgaagtgggccgttccactaggctgcatggcctacacagcaagtctaataacag

SEQ ID NO: 1391 - DNA, 82 bp, Homo sapiens
aatgatttttctctcctaggaatgccagaatcacctccgcagatatggaaatgtgaatctggaactggtgactcgaatcatt

SEQ ID NO: 1392 - DNA, 86 bp, Homo sapiens
ctcctagtggtatctgtcataaagatactgttcaaggcatatttcattatattttatagtgtcctctttatggtgacccttgggag

SEQ ID NO: 1393 - DNA, 82 bp, Homo sapiens
ctatttagttacattctgtggcctggtctcctttgtcaacagtaggacatattaaggagacagctggtcagtaataaaagag

SEQ ID NO: 1394 - DNA, 77 bp, Homo sapiens
gcatttgggagcaaatgttaatgaagaagtaaaggcaacttatggctttttcagttctttcatttccctctagatgt

SEQ ID NO: 1395 - DNA, 83 bp, Homo sapiens
gaggttactttaaagataagaagcagcatttggaaggagattcatttcctgcctttgggctttatctgcaagaagtacatctt

SEQ ID NO: 1396 - DNA, 80 bp, Homo sapiens
tggcaggaagatggcactggccaggttgccggtgacaccactcagcaggtagatgatggctatgcggtgccagcctgcca

SEQ ID NO: 1397 - DNA, 73 bp, Homo sapiens
acattcagtgtaaagggtgttatgaaaatgtaaagttcattaatatgctgtatatttttatccccttgaatgt

SEQ ID NO: 1398 - DNA, 73 bp, Homo sapiens
agggggtgggaggtctgtttggcaactggggtgaagggattgcccttcccctgctgggattcccccagcccct

SEQ ID NO: 1399 - DNA, 75 bp, Homo sapiens
aggcagctttgactaatgtctggtgatgtgttagcagatacatttctgtctagacaacaaatcaatatggtgcct

SEQ ID NO: 1400 - DNA, 86 bp, Homo sapiens
ttagttattttcctctcttctcatcctttgtgcctggttctctagaaggctgatcttttagttccaaggtagaattaaataactaa

SEQ ID NO: 1401 - DNA, 84 bp, Homo sapiens
ggacagcacacccagggtgtctttcagtcttattgatttgaaatcacattcaatgactgacttggaatcatcaagtggctttcc

SEQ ID NO: 1402 - DNA, 88 bp, Homo sapiens
atgcaaagggctacgttaattccacactgtggctgagattttaattgcactcaagttaggaaattcggagttaatgttcccctggcat

SEQ ID NO: 1403 - DNA, 76 bp, Homo sapiens
ggtaattcaaaacaaatttcaagctgtgacaataaaatggttcttgtagtaggttggggtttgtgctgaaattgcc

SEQ ID NO: 1404 - DNA, 85 bp, Homo sapiens
cgaaaatcatttagactaattggtacattatacaatctaactgtgtaattgatttttaaatgaattggtccctaagtgagttttg

SEQ ID NO: 1405 - DNA, 85 bp, Homo sapiens
tcaggcccatttaacacaatctgtaccactcaatgaatgtgcagtaccctacacacatcaaatcagatttggataatgttcctga

SEQ ID NO: 1406 - DNA, 87 bp, Homo sapiens
agacaaagaacaaaaggtttaatatattacagagaaacagttaatgataatgtaatattttttaaaatggctttttgttgtttgttt

SEQ ID NO: 1407 - DNA, 72 bp, Homo sapiens
gcagcagaaaggcagtattgtgtgtggtcatggagagcatccgaaccacacgacagtgctcactgtctgtgc

SEQ ID NO: 1408 - DNA, 76 bp, Homo sapiens
cccagggaagcctcgatcagttggatgaggtggcagccctcattgctgccacagtccatgacgtggatcacccggg

SEQ ID NO: 1409 - DNA, 87 bp, Homo sapiens
tgtttattttttcggattcaaatgtgttaatatagagctttgttaaaatggaaagcttaattaatgcagattaaatctaattgaaca

SEQ ID NO: 1410 - DNA, 88 bp, Homo sapiens
catgagggcactttgtaatgtctttaattaccaccctggtattgtgattagaaacaaagacatttcaataatagtgttctattgcatg

SEQ ID NO: 1411 - DNA, 90 bp, Homo sapiens
tgctgtgaaacaattgccatattttttaaagtgttgtctgtgttttcttagaggcattcctgctcgaaaagatgtggtaacttcattcca

SEQ ID NO: 1412 - DNA, 79 bp, Homo sapiens
gtttacaagacatgatattgctgcttttacaaaaggacattctatttattttcgcagtaattctcatgtccccataagc

SEQ ID NO: 1413 - DNA, 88 bp, Homo sapiens
agtgggagtatatttaaaatgcaaatattatacttgagatgctaaaataatttacattctgaggctgcagtttaaatataattgcatt

SEQ ID NO: 1414 - DNA, 70 bp, Homo sapiens
tttattgaaagtgaattgttattatttcagggatgaatgcatattggaatatgctgattattttaatgaa

SEQ ID NO: 1415 - DNA, 88 bp, Homo sapiens
gctataacaacagtagtaaagttctaaggagaccagagggtccccacaaccacacacttcctgcagctgtggctgctgtaattatggc

SEQ ID NO: 1416 - DNA, 88 bp, Homo sapiens
gtttgtcttgaggaagatctggcatattttcatccaaaaggtctgctaaggattgagaatttgccagcagcttctggtaagacatagc

SEQ ID NO: 1417 - DNA, 80 bp, Homo sapiens
gcagtattaactcaatttgctggtgcaggtgacaaatggactttgctacctgactaatcatgtcaccgagacaatgctgc

SEQ ID NO: 1418 - DNA, 75 bp, Homo sapiens
gtcttcactttcagctccaaggtggcatcctcgtcacacacaaacacggtgcggggatgctgctggaaggcagac

SEQ ID NO: 1419 - DNA, 90 bp, Homo sapiens
gggagacattccacttataggaggcaaagagcaggatatctgcacaggaagagttcatcttatatgactttcggggatggattgtctcct

SEQ ID NO: 1420 - DNA, 74 bp, Homo sapiens
agctaatatggtgtgatctggagaaagctttgatgcagggactttgcaaataaacctccagatgccatatggtt

SEQ ID NO: 1421 - DNA, 89 bp, Homo sapiens
ttgactgtatccatttgtcacttcagcttaagtccagtttggccaatttgattaaattgactggttctttcactgaagtgaccagtcaa

SEQ ID NO: 1422 - DNA, 90 bp, Homo sapiens
acatgctgctgtcaaaaagggccttgccttcagtgaaaatgggagattatgtcgctgggaggttatagagcttctcttagggcagcaagt

SEQ ID NO: 1423 - DNA, 70 bp, Homo sapiens
ctttagggatctggtacttgaattttaattaaaccaaaattattcattgttcagttctaaatccctaaag

SEQ ID NO: 1424 - DNA, 75 bp, Homo sapiens
gttcaaagggcagagttcagctatggttcaggttaattgaacaggaagcagtgagctctccaggctgtgttgaac

SEQ ID NO: 1425 - DNA, 80 bp, Homo sapiens
agagcgcagctactggtgctttgcaggaggcaagtgaggcctatctggttggcctttttgaagacaccaacctgtgcgct

SEQ ID NO: 1426 - DNA, 85 bp, Homo sapiens
ggcccagaagatgaaaagctgaagtcctttcccttccagctgaagccaggtgtgatgctggcagggagaggttccaagcttggcc

SEQ ID NO: 1427 - DNA, 88 bp, Homo sapiens
cagcatgccctaattttgtaattaacaatgaatcaaaagaagctattaagcttctgttgcatgtctattcttaataaacctcatgctg

SEQ ID NO: 1428 - DNA, 78 bp, Homo sapiens
gtcaaaactggttttccctgccctaacccaggcgcctttgttaagggcctggcaggatggggcatgaatgagggtgac

SEQ ID NO: 1429 - DNA, 90 bp, Homo sapiens
gtgaagaatgcaggcaggttgtgattagaggtgagccagttcctgattgtgggttaataagctctgctaataaactgcctgtagctttac

SEQ ID NO: 1430 - DNA, 74 bp, Homo sapiens
tgcccattagtatctgaaatgatgtaatggcactctatctgtcaaattgcttaaaattatttgtattaagggca

SEQ ID NO: 1431 - DNA, 78 bp, Homo sapiens
gccggtggggtgagtgtagaattgataaagatttttgaagaaatatcagtttctgtacaactgcgaaatcctcctggt

SEQ ID NO: 1432 - DNA, 90 bp, Homo sapiens
gtcagaggaaagatatacatatgcccaaagtatacacttgtgcttgttcacagtgttatttggggaaaatatgttgcatgttctcctggc

SEQ ID NO: 1433 - DNA, 75 bp, Homo sapiens
taaggcaggatgattcgggaaatggactatttaaagcaagctgctttggacttgaatacccccatcctgcgctta

SEQ ID NO: 1434 - DNA, 89 bp, Homo sapiens
ggtcatgctatgcctggggtgagttttgcctcggggctccaggcggcactggagcagagctgagctaattttacccacaggagctgact

SEQ ID NO: 1435 - DNA, 75 bp, Homo sapiens
actgggcgatccctatctttgtccacctttgtcatcatggacccagatgagagagacttgggtatgcagcccagt

SEQ ID NO: 1436 - DNA, 74 bp, Homo sapiens
cctctccctgccaaggttttaaaagcatctgggcacaggtgcgggtgctgccagcctccagggctaataagagg

SEQ ID NO: 1437 - DNA, 78 bp, Homo sapiens
tgagaaccgtttgagttgggtctagcatttgctatggacaagatgccaggacctgtatgcttcagaatgaagttctca

SEQ ID NO: 1438 - DNA, 81 bp, Homo sapiens
agctgcctcctggtttcgcaaagcatggatattaataagggtgattagtaatcatgacgtgtgaataataaggggatggtt

SEQ ID NO: 1439 - DNA, 84 bp, Homo sapiens
ggggctgaccaagcggcagatggattgataaacctttcaaaggggaaggtattcccaaggagggccgctgcgcctggctgcccc

SEQ ID NO: 1440 - DNA, 77 bp, Homo sapiens
ccttctgaatattaattaacattgtttcaaagagacagccgctgtttatcattgatttaaattaaatattgagaagg

SEQ ID NO: 1441 - DNA, 73 bp, Homo sapiens
ccgattatggctttcttctcctgccctttcagtagtgatttgcagaaacaggctgggagaaaggggtctttgg

SEQ ID NO: 1442 - DNA, 81 bp, Homo sapiens
aagaggtaatgtagtcacagtgacaaagttagattacaaggcactaagttgcttctgtaaactgttactgctttttctctt

SEQ ID NO: 1443 - DNA, 90 bp, Homo sapiens
gcttttatatggttcatttacatctgtgttatgtgataaaggtggtgatttcttgacgcagcaatatagatgagtttccccattaaaagc

SEQ ID NO: 1444 - DNA, 80 bp, Homo sapiens
tccaaacacttagtgcctcattagctgatagctgtagtctaatgactttcagaccaaatgagagcttccagggtgttgga

SEQ ID NO: 1445 - DNA, 79 bp, Homo sapiens
cagagacagctgcacagttggaaatggaggctgaagatacagttgatgtgttccaacagcagatgggaggtgtctactg

SEQ ID NO: 1446 - DNA, 85 bp, Homo sapiens
gaaatgtgttcctttggtccttcagcctgcagcactctgtgcaaaatacagcagagagctgggcactgggccaagcttacatttc

SEQ ID NO: 1447 - DNA, 70 bp, Homo sapiens
aagaggataatgtatatttacaactacagcttcagtgttattgtagttatagattctatttatatccctt

SEQ ID NO: 1448 - DNA, 86 bp, Homo sapiens
tccctctatacaaggtgggttttgcattgtcccacacatagtctgctgatggccgtgggatggcaaagtcatcttcattagacgga

SEQ ID NO: 1449 - DNA, 76 bp, Homo sapiens
gctctcttcacagggatgttacatgccatgagaacaggtttctctgtcatgtgatatgaaacagggaagcagatgc

SEQ ID NO: 1450 - DNA, 74 bp, Homo sapiens
ctaggattagtttgttatttctcctttaagtaggttaagctttttaaagcaggggtaattaagattatgactag

SEQ ID NO: 1451 - DNA, 73 bp, Homo sapiens
aagtgcatcgtatgcttataataaatagtttgcacaaaattattcattccacatatgggcagagcgatgcctt

SEQ ID NO: 1452 - DNA, 79 bp, Homo sapiens
gtcggtcttggcttctggagggatgaacttgatatcaatagttattaggacacattcatacaagatacacaagagtgat

SEQ ID NO: 1453 - DNA, 81 bp, Homo sapiens
ctgttgttagtgaaaattgattacctattaagtgctgagtgagaaggttagccttaataatttcatttggcttgcatacag

SEQ ID NO: 1454 - DNA, 89 bp, Homo sapiens
ggcgctgtcggccggggcggccgccggcaactcgtccgtcttgataaccatggtggcgggagcgggcgtccgcctcggctgtccgcgcc

SEQ ID NO: 1455 - DNA, 74 bp, Homo sapiens
gttgataagatctaattatatgtttgcagctgtttcaaatctgtaaatatctgaagttggtcaacattatcaac

SEQ ID NO: 1456 - DNA, 85 bp, Homo sapiens
aggttactgattcaacaggcttcctggtgctgcagcccagaatgcagtgaggctgggaagccccggggagggatctaagtatcct

SEQ ID NO: 1457 - DNA, 73 bp, Homo sapiens
ctggagtggtttacagcagcttttaatgtatgttttgctaattgaaagttacagtggtgctgtaaattcccag

SEQ ID NO: 1458 - DNA, 84 bp, Homo sapiens
tttcagaacatttgtctgtaattggagagcccctgcctatgaagctacaaagactgggtgaccctgcagacccttgttttgaga

SEQ ID NO: 1459 - DNA, 78 bp, Homo sapiens
gcccttgaaataatgagctgtgatctatgataaatgtgccaataacacattttccagggcagcatatttcagatgggt

SEQ ID NO: 1460 - DNA, 89 bp, Homo sapiens
tagacttgcaaatgatggaacatttaattattccaaaatagcattccccagttagggtatgatcattaaatccatcatccttcagttta

SEQ ID NO: 1461 - DNA, 87 bp, Homo sapiens
atgttcttagtgctgctcatctgcctgctggataatagattgattcataatttcagtaagcagctgtgtatatctttccctgaacat

SEQ ID NO: 1462 - DNA, 79 bp, Homo sapiens
taattcactaatagcattggagaggtgctaaagtttttcaaaactgcagattgacctaattaatgtcttttctgaattg

SEQ ID NO: 1463 - DNA, 78 bp, Homo sapiens
tggtcagctatttgcttgtatttcaaggataatggatctatttcctccttcagaatgagtgcgataagttgttgacta

SEQ ID NO: 1464 - DNA, 85 bp, Homo sapiens
tgtacctgatcatcgccatctgtgcggtgtccagcctgctggtgctcacgctgctgctgtacaccgcgctgcggtgctcggcgca

SEQ ID NO: 1465 - DNA, 80 bp, Homo sapiens
accatttgcaattagtttcctgggctctggagaacagtttttaatggctatgccaaatgttctgtagtgtcccaaatggt

SEQ ID NO: 1466 - DNA, 70 bp, Homo sapiens
gctagaccttctcagaaagtacatttacattaatattaattaatgcaaacagctgtttgagaaagccagc

SEQ ID NO: 1467 - DNA, 76 bp, Homo sapiens
gctggctgaagtcagaggctttgcatatcatgtattacatggcaggcaatgaagaaggcttctgaggctggccggc

SEQ ID NO: 1468 - DNA, 81 bp, Homo sapiens
tatttatgatgtgtcaaattactgttctgagagcagaccttttaggttgcattcagcctttaatgtgactgaatttaaatg

SEQ ID NO: 1469 - DNA, 76 bp, Homo sapiens
agaagctcttacaagttgtgaggaagtcatatcttaagaaggatcagcctcctaacttcttgataaattagtttct

SEQ ID NO: 1470 - DNA, 74 bp, Homo sapiens
acacttagcagaaggttcctaacataaacaaagctgtgcacgttttgtttatttatgggatctatgcaaagtgt

SEQ ID NO: 1471 - DNA, 83 bp, Homo sapiens
ccctcctgtgagagtctgaaggatactattgccagagctctgcccttctggaatgaagaaatagttccccagatcaaggaggg

SEQ ID NO: 1472 - DNA, 76 bp, Homo sapiens
gaaattgtaaattttattgttttaacgtgtatgcatgtttagtgacgtttacattttgaaataaaatttatgattc

SEQ ID NO: 1473 - DNA, 86 bp, Homo sapiens
cagatacatgaaggtaagaagctgttagaggagcttttatggcagatggttcttggcagcaattgctttgcttttatggcagtctg

SEQ ID NO: 1474 - DNA, 85 bp, Homo sapiens
gctaacagcttgttagaattcagaaatgccacccgctaatcagcccacctgtggcattctcagtccatcttgcaagctgcatagc

SEQ ID NO: 1475 - DNA, 74 bp, Homo sapiens
aatttaggacatgactcagtttcttaacacattgggggaaaatttcttcaaagaaaggagtgatgtgtgaaatt

SEQ ID NO: 1476 - DNA, 83 bp, Homo sapiens
gtatcattatctaaactttcagtctgaggtttagccgtccctgaacaatcacggctcagcactgaaagtaaagatgtatatac

SEQ ID NO: 1477 - DNA, 73 bp, Homo sapiens
gtaaaatggagtgttgtttatcatattcggaagcaacaactgagtatgatctttggaagacagttctctttgc

SEQ ID NO: 1478 - DNA, 75 bp, Homo sapiens
tttatatgcctaaacattctctctaatattaatttcttaagaaggtgatttggagttaattgcatggcaaatgaa

SEQ ID NO: 1479 - DNA, 74 bp, Homo sapiens
tgagggcctcagtttcctaggagacggcttcttgaattagtaagagcatttctgctgcctagcctgaggcctca

SEQ ID NO: 1480 - DNA, 85 bp, Homo sapiens
gattcagtgtgcagcattatggaaccaaaagcatagccaggactcagcatggagcgtgatgttgcataagtaagaaaattgaatt

SEQ ID NO: 1481 - DNA, 90 bp, Homo sapiens
aatgtagatttcttaagtagctgacatttattttatttcctaccacctgatcttggtaccttaaaatctgttttttatttgttttacatt

SEQ ID NO: 1482 - DNA, 87 bp, Homo sapiens
ggaagggcactgtctctctgattcccagggcctgtcatttcccgagggctggtggagcccggggattggagggcaagaagcccagcc

SEQ ID NO: 1483 - DNA, 70 bp, Homo sapiens
gaaggttccactgtgtgttgaaaattgtctaaatggggggataatgaacagtcaccaaattggagctttc

SEQ ID NO: 1484 - DNA, 70 bp, Homo sapiens
cgcgcccgagctgcaggacgacttctacctcaatctggtggactggtcgtccctcaatgtgctcagcgtg

SEQ ID NO: 1485 - DNA, 86 bp, Homo sapiens
gtctgcctctttctctgcagtaattgcttcctgacatttgtttattttaattaggagagcagtcttgatcaagagggagggcagac

SEQ ID NO: 1486 - DNA, 89 bp, Homo sapiens
cagagcagagttcatgaactcctgctaatcatgttaacaatctaccaggtttctaaaggctcagcaggggttagaattagaaggctctg

SEQ ID NO: 1487 - DNA, 78 bp, Homo sapiens
tgctttgcccttagtccatgcacagagaattctgattgatgtcaatgggagccatgtgcaaagtttgcgggcactgta

SEQ ID NO: 1488 - DNA, 90 bp, Homo sapiens
attaatttggttccttgtacacttgaatcattaattttgttctggtaacagagcaggctatttaatcaaacctaaaggaaataaaataat

SEQ ID NO: 1489 - DNA, 80 bp, Homo sapiens
ccttctgatggttggagatgagtgacaagcctcgtaattgaagatggtggggctgataattcgacagtagcctcgggagg

SEQ ID NO: 1490 - DNA, 70 bp, Homo sapiens
tcgtctttcaaatctagctatgctgtaaactgatgtttgctgtatgctcctcctgatttgaaatagatga

SEQ ID NO: 1491 - DNA, 76 bp, Homo sapiens
caagctctacttgtgtacagtgtatattgtataatagacaattgtgtctactacatgtttaaaaacacattgcttg

SEQ ID NO: 1492 - DNA, 90 bp, Homo sapiens
tgaagatcaagtccctggaggagatctatctcttctccctgcccattaaggaatctgagatcattgatttcttcctgggggactctctca

SEQ ID NO: 1493 - DNA, 74 bp, Homo sapiens
gaatactccaacagactgtaagcctgcctcagacagccattctggttgttgggctaattgttagctggggtttc

SEQ ID NO: 1494 - DNA, 80 bp, Homo sapiens
cttcttataagtctgtggtcacagtatgttttttgcagttcagcatctggctctgtgggatactgatggcttctaggaag

SEQ ID NO: 1495 - DNA, 81 bp, Homo sapiens
tctcacaagaagagatcccagtggccattgtttcttctaggaacaatggtttccagttaacacatggcacagtctgtgaga

SEQ ID NO: 1496 - DNA, 74 bp, Homo sapiens
gtttgagctggaattaaatgtgcacagctggtaccatctgctgcaaattctttaattcttgttatctcttaaac

SEQ ID NO: 1497 - DNA, 79 bp, Homo sapiens
tctctgtgtttattcatatttctgccaaatgtcgatccagaaatgtattagcatctgccagtgatgaataaacataaga

SEQ ID NO: 1498 - DNA, 82 bp, Homo sapiens
taattggcttaacttattagactgtaggttagaatataaaaatcaaactataaaattaatctgctgtacagtgtgctaatta

SEQ ID NO: 1499 - DNA, 83 bp, Homo sapiens
atccagctggaactgtctcttgtaatttaatatgcaaagaaataatctgagtcatagatgaagacaagcagttccttttagat

SEQ ID NO: 1500 - DNA, 88 bp, Homo sapiens
actttcaagtcttccaaattctgcagctgcagggctactttgaggaaattcctgtttcttccagctgctgagaaggaagttttaaggt

SEQ ID NO: 1501 - DNA, 84 bp, Homo sapiens
tcagttatgagtggctgtaaagtaaaatatattatgattattacaatgataaagtatacgcttttaagagtctgcttatattga

SEQ ID NO: 1502 - DNA, 71 bp, Homo sapiens
ttcaaattatatagaatctagtttttaaaatcagcacagatcttcttaaaaactgtgaactatgttttgaa

SEQ ID NO: 1503 - DNA, 89 bp, Homo sapiens
tgggtgtgtggtgtttgtgcctgggcgtgcgatttaatggagcgcctctctgcctctccagtgcggccagagctcgcttcgcgcaccca

SEQ ID NO: 1504 - DNA, 83 bp, Homo sapiens
gagctattatttatagaatatttaaagagcctggactgcatgtgcctctgtcttgggttctattgtactataaattataggtc

SEQ ID NO: 1505 - DNA, 78 bp, Homo sapiens
tgtttacatcttagaatgtcaaagaatttcagttagttaattatgctgcaggtgggcagatgtatctaggagtagata

SEQ ID NO: 1506 - DNA, 74 bp, Homo sapiens
ctgggaaggtgttaatagatataaactgtgcaatttgctgaaattggcatgatatctttattataccctctgag

SEQ ID NO: 1507 - DNA, 82 bp, Homo sapiens
gcaactggaggaatgaacaggaagcttttaactagtggtttcaattagcactgatattatttcctgaacagttctctagtgc

SEQ ID NO: 1508 - DNA, 80 bp, Homo sapiens
aataagacattcctgctaatttgccgggagctgaaagggatttctgtttttagctttgggtctgtggcaactgttttgtt

SEQ ID NO: 1509 - DNA, 87 bp, Homo sapiens
gatggccttgtccttgggcacgcatcgggcacagttagtgcagcgaataggctgcacgtggccgcggccctttttggcacgaccatt

SEQ ID NO: 1510 - DNA, 82 bp, Homo sapiens
tgttttcatcttgcttcttcatggtccatgatgccagctgaggttgtcagtacaatgaaaccaaactggcgggatggaagca

SEQ ID NO: 1511 - DNA, 74 bp, Homo sapiens
aggcgccatcaccattaatatcagatagagcagtaactaattcagtcatgttgatggatgccgagatggtgcct

SEQ ID NO: 1512 - DNA, 71 bp, Homo sapiens
gcatgtccaccggggtgtggaaggaggtcttggatttctcatatcccttcttgtattcccggtctgactgc

SEQ ID NO: 1513 - DNA, 85 bp, Homo sapiens
aaaatcgaagaagaaataacatcaaactagtttgttcctgaaaacaaggcaacaagaaattgatggcattttcacctgtgatttt

SEQ ID NO: 1514 - DNA, 73 bp, Homo sapiens
acattcttgtccactctgaccttgtaatatttctcacagttggaaatgtaatgcagagtgactaagataatgt

SEQ ID NO: 1515 - DNA, 87 bp, Homo sapiens
tagggcaggagaaaaaattctaagttgtcctaaattccttctcttactgaaaataggacaatgaaacaagaattctgacttgcccta

SEQ ID NO: 1516 - DNA, 84 bp, Homo sapiens
gcactttgaagtcattttatgccacttgactcaaatcattcatctcagtgaaaatttgttagttaaatgtcagcttcttggtgt

SEQ ID NO: 1517 - DNA, 79 bp, Homo sapiens
gtggtcaagtttgtttctcctgggggcgctcttccgaggatatttgggctgcctccggagtcgcagtgtcttgggccgc

SEQ ID NO: 1518 - DNA, 89 bp, Homo sapiens
cactcagtcttggcagtgcagatgacaaactgggaaccatttgttttgggcccagcatttgccatggacaagatgccaggacctgtatg

SEQ ID NO: 1519 - DNA, 86 bp, Homo sapiens
gtttctgtctgtctttcttccttcccaatctgttttgacatcaagactaccttgttttgtcaactgtgctggagacagataaggat

SEQ ID NO: 1520 - DNA, 82 bp, Homo sapiens
gcccctgcgttttcacaacagctcaaaggcagatgcatcaatcctcccaggggctggaaacgtgaggagaatgccaaggggc

SEQ ID NO: 1521 - DNA, 90 bp, Homo sapiens
tccactgttggctttagtcacggcggggatcgtcagtttagcgcggccatcgctaaaggagatctgcacgccgggcagagtggaagtgga

SEQ ID NO: 1522 - DNA, 81 bp, Homo sapiens
gctaaagccaggattgtgttgggttgaatatattttaagtatcagaggtctatttttacctactgtgtcttggaatctagc

SEQ ID NO: 1523 - DNA, 89 bp, Homo sapiens
tattgaagcccatggatcttatggtagaagcgagtccacggcgaatttttgcaaatgctcacacatatcatataaattccatttcagta

SEQ ID NO: 1524 - DNA, 86 bp, Homo sapiens
agaatgactaagaaatcttttcctgcattgccatatagttgttaaagttcaagtggtaaacaaataaaggatggaaatgtcattct

SEQ ID NO: 1525 - DNA, 74 bp, Homo sapiens
ctgacatttactttcactcatgagcacaggggtgaccagccccaccagtcctagatgctgaagataaatgtcag

SEQ ID NO: 1526 - DNA, 84 bp, Homo sapiens
atttcagcagctggttagctggacaggaatagaacattacagaatcaccttgaatctaaagcctgtgaaccagctgtctgagat

SEQ ID NO: 1527 - DNA, 84 bp, Homo sapiens
gcagatgggagaatatccactaatgttttctgcagataatttgaaaagtcacttctagcagattgtgtctcttctctgatctgt

SEQ ID NO: 1528 - DNA, 84 bp, Homo sapiens
tgtttaagagatgctatttgctttttgggtcacaggctgcaaaaacaggctttgatccgaagtgggcgaataatttattgagca

SEQ ID NO: 1529 - DNA, 87 bp, Homo sapiens
tatgtttcaattaatgacatatgcatatgtatgccaaaaagaaacaccctgctatgcatatgcatatattattaattatgcaacatg

SEQ ID NO: 1530 - DNA, 80 bp, Homo sapiens
cagccaaggtctgtgtggttcctctttgctttctgtcattaatcagtcctgaagcatcttctagacagacagcttggttg

SEQ ID NO: 1531 - DNA, 74 bp, Homo sapiens
agcctaaatacattagcgagctggtaaagcttttaaggccttcttgggagcgagtggctggctaatgagaggtt

SEQ ID NO: 1532 - DNA, 71 bp, Homo sapiens
ctcttgatgtatagtatgcctgtattatagtttttacaaaattgtgaacttgtgtaatagtataataggag

SEQ ID NO: 1533 - DNA, 76 bp, Homo sapiens
gtccattattattttcaacctgtgttaataatgtattagatgagtttattgcatagatgtgaatgtatagatgggc

SEQ ID NO: 1534 - DNA, 77 bp, Homo sapiens
aggcctaaaaaattgatttttatggctcttcttgtaattctctttttgaattaggcacatgatattgatgtgggcct

SEQ ID NO: 1535 - DNA, 81 bp, Homo sapiens
gaacgcttagcaagtcttttccaaggctgttccctctttccggggaaataaagcctagattggaaccttctgcccagcttc

SEQ ID NO: 1536 - DNA, 84 bp, Homo sapiens
caggaaatagaagagctaggacaaagcatggatgtcatgtagaatattttatgacaaactgctgacctgagccaataattcttg

SEQ ID NO: 1537 - DNA, 78 bp, Homo sapiens
gctgcaaaattgaaggtgtatttttatagacaaggtagaagcctctgaaaatgtataccaaatgtcttgttttgtagc

SEQ ID NO: 1538 - DNA, 80 bp, Homo sapiens
agagttacttacagatagcttcattacagagagccaaagctgcagcacagtctcctttctgttccagatgtagtgactct

SEQ ID NO: 1539 - DNA, 88 bp, Homo sapiens
tcaggacacattattcaaatgaggatatgaaagctgtcggcctacagctgcagcctccctcattctacagaatattgggacctcctgg

SEQ ID NO: 1540 - DNA, 83 bp, Homo sapiens
tgcagatagataacaaacacttctttaatcttctctttgaagcttcagcttcaataggaaagggaagctatcactcctctgca

SEQ ID NO: 1541 - DNA, 70 bp, Homo sapiens
aatgagaaattttcagggctactgaacactgaaaatgcatggtgctcaatggccctaaaaatttctcatt

SEQ ID NO: 1542 - DNA, 87 bp, Homo sapiens
ggtctggggctgcagaaacaggcatatatagcagagataattaaaacatttcatgattatgacagccacattctgctgctgcaagct

SEQ ID NO: 1543 - DNA, 79 bp, Homo sapiens
gtcctttaaatgctaaataataagttaaatgcaaggaataaataagttcagtagcttatttatggggtaattaggggat

SEQ ID NO: 1544 - DNA, 83 bp, Homo sapiens
ccctcctgtgagagtctgaaggacactattgccaaggctctgcccttttggaatgaagaaatagttccccagatcaaggaggg

SEQ ID NO: 1545 - DNA, 81 bp, Homo sapiens
tcagaatgcagggcctggcctacaatactggagttaaggaaattcttaacttcttccaaggttaccaggtcagtagcttga

SEQ ID NO: 1546 - DNA, 88 bp, Homo sapiens
ggcctttgaagccattgtgaaaaaacagattgtaaaactcaaagagccgagtttgaagtgtgttgatctcgtggtctcagagctggcc

SEQ ID NO: 1547 - DNA, 72 bp, Homo sapiens
tctttgttaaaatgtaaaatgcatattgggcaaatgctccagggcaatttgcataaaaagtgatgacaaaga

SEQ ID NO: 1548 - DNA, 85 bp, Homo sapiens
ggacactctgaaccccaagtggaattccaactgccagttcttcatccgagacctggagcaggaagtcctctgcatcactgtgttc

SEQ ID NO: 1549 - DNA, 89 bp, Homo sapiens
ctgtgtatgtttgacgtgaaattaaacatagctccagatgtcctgtttgtagcaaagccagttaattttattagaacatttaatcacag

SEQ ID NO: 1550 - DNA, 74 bp, Homo sapiens
aggggacaggaaattatcttctgcagttgtatcctgtgaggacactactaattagaagccatttcctgctctct

SEQ ID NO: 1551 - DNA, 83 bp, Homo sapiens
gttcacattaaaatataaattccctgtgggagagaccctattaagccttgcagggaattgctaatttacatcttaatgtgaat

SEQ ID NO: 1552 - DNA, 78 bp, Homo sapiens
tgtaaacatgagttagacaatatttgtagaacttgatataatgttaatttacaattttcgtctctacaaatgtttgca

SEQ ID NO: 1553 - DNA, 84 bp, Homo sapiens
tcccctgatttccctctgtggaagaatgtgtgaattcacatgcatcctgtcctaactgtgcaggggaaaattccagtcagggga

SEQ ID NO: 1554 - DNA, 90 bp, Homo sapiens
tgacctgcagctgtggaaacaaggacatattttattgtgcccatgttgtggcactgtctttataccgcatccgcaagccagatcaggtca

SEQ ID NO: 1555 - DNA, 80 bp, Homo sapiens
tatgtgtgctcaataactcctaaggcaatcatcttcaaagtcttttctctgctggatggttgtctgaacagcatttcata

SEQ ID NO: 1556 - DNA, 74 bp, Homo sapiens
aactagacattttgtagtaaagaattcttgaaattctctaataaaaagcaattcttactgtaatatttttagtt

SEQ ID NO: 1557 - DNA, 90 bp, Homo sapiens
aaaccagttagtcaattcgttcaggtccctaagtggcgatttgtggtaatgtctacatcaatacggacggagcggtttgctagctggttt

SEQ ID NO: 1558 - DNA, 82 bp, Homo sapiens
tcttagtccagtgtagagcttttctccatgtttatgcaaaaccattgtatatgcatttctatagagctcctcaaaactaaga

SEQ ID NO: 1559 - DNA, 75 bp, Homo sapiens
tctccatcctctgtctcccttgatcctctgttctccctgatggctttgagatgaaggcgacggcaaggatggagg

SEQ ID NO: 1560 - DNA, 85 bp, Homo sapiens
cttgagaagttatgggttcttttaaccttttgaggaaagcttttattcatctagcgttatttaaaaacccaaatgactttttgag

SEQ ID NO: 1561 - DNA, 76 bp, Homo sapiens
tagctgcctcagagtagaaaataaaactcaacaagattttatcttgtttttaatttctatgtctccctggcagctg

SEQ ID NO: 1562 - DNA, 78 bp, Homo sapiens
atgaaatttgagaaagactttgactttgaaagtgcaaatgcacaattcaacaagggagagatcgacagagagtttcat

SEQ ID NO: 1563 - DNA, 82 bp, Homo sapiens
aaggagaaaatgtttgggatctgattaagaagaccagatttcctgtcaacatcctgtcttcttttaatttcaaagactcctt

SEQ ID NO: 1564 - DNA, 87 bp, Homo sapiens
gagctaaacaaagagggtctgatgccaatcctggtgccagtggcaaccatctttggcattctctctgttctttctcatgtttttctc

SEQ ID NO: 1565 - DNA, 89 bp, Homo sapiens
tggggtaataggcagctttctgtgcagtcacaaataataggtcgcgtctatttgcctatttgagtgtgcgagaaatgtgtgttgtctca

SEQ ID NO: 1566 - DNA, 84 bp, Homo sapiens
actcctgataacacttgctacatatcatgttttaattgcttgtacagttaacctttaattttatttagtaaagtgtatcaaagt

SEQ ID NO: 1567 - DNA, 81 bp, Homo sapiens
gcatgtgatcatattgcttctagaatttatgattgttttcttccaaaaggaagctaaatttagcctagtaattctacatgc

SEQ ID NO: 1568 - DNA, 83 bp, Homo sapiens
ggcctgtgattgggcagattttcattcagttatgtttaagatgttttcaggcatgcttggttttgagtaatgcctagcagggc

SEQ ID NO: 1569 - DNA, 78 bp, Homo sapiens
gtgagaagagatagcatagtttgtcatgggaagataggccatattctgctacaaactgatggctttgtcttttatcac

SEQ ID NO: 1570 - DNA, 89 bp, Homo sapiens
tattcatcatttctccttttatgagcaccttggcaattctctctaaaggcgaaggctgcagtaaattcagaagtgccatttagtgaata

SEQ ID NO: 1571 - DNA, 84 bp, Homo sapiens
tccagattttatgctaattcagtttcaggttcctttgaacctgcagtttatggggccgtgctgaaaactgcaatctgttttgga

SEQ ID NO: 1572 - DNA, 79 bp, Homo sapiens
cacattttgttgacttctgacattccactttcctaggttataggaaagatctgtttatgtagtttgtttttaaaatgtg

SEQ ID NO: 1573 - DNA, 76 bp, Homo sapiens
ttatgttgctccattgagtgttgttggatagaaaaagaattgcttattcattcattatgcttaattaaaaacataa

SEQ ID NO: 1574 - DNA, 72 bp, Homo sapiens
gtttcatgatctatttatacattggatgatatttatttaatccagttttgtattagaaatggatagtgatgc

SEQ ID NO: 1575 - DNA, 86 bp, Homo sapiens
tggtatctacaaaatttttcatttggatgtgtttgtatttgctaagtacaaatctacaccaatattgtcacttgtatattgtacca

SEQ ID NO: 1576 - DNA, 82 bp, Homo sapiens
tagttgggtagggtggcactgagaccaatgagtcggacatcctcttgggtcatctcaatgtttcggatggccctggccacta

SEQ ID NO: 1577 - DNA, 72 bp, Homo sapiens
gcctgtttatgagatggcatttctctgatgcttatttgtgctcatgggatgttgccagctttctgagcgggc

SEQ ID NO: 1578 - DNA, 85 bp, Homo sapiens
ctgggaacaatggggccattgtgggaggatggagtgcagcagactgctggcacagccaagcgcaccacggtgggacctcacccag

SEQ ID NO: 1579 - DNA, 72 bp, Homo sapiens
gccattatccaacaaacactataaaaatgtttgaacaattggatttcaaacattttcgttttgtggagtggt

SEQ ID NO: 1580 - DNA, 83 bp, Homo sapiens
gtcattggccatttgctgcctgcttcaccagacgtgttttgagcatgtttgcataaagtggatgcaggctgcaattccgtgat

SEQ ID NO: 1581 - DNA, 70 bp, Homo sapiens
ccagccgccgccagtctccggcctcggatgttgacacaaacccgaggcggtttacactgagcgggtctgg

SEQ ID NO: 1582 - DNA, 74 bp, Homo sapiens
ggcctatgttctataagattaattacataatgtttgggaaaatgtctagaaaaattagtctgagaggaaaggcc

SEQ ID NO: 1583 - DNA, 87 bp, Homo sapiens
ggtgtttggatggatgaggatggtggatgatggatgagggagacggaggattcccttattaaagcatcaaattcttccctaaatatc

SEQ ID NO: 1584 - DNA, 74 bp, Homo sapiens
agtttaatatacttaatatccagtgctgaaagtgttttcattttgtccctaatgcactgaaagtgttttaaact

SEQ ID NO: 1585 - DNA, 90 bp, Homo sapiens
cagagaacgtgtaccatgtttgcttgtaattagcactctgacagacgtcagagaaaatggctaatcactgacatggcccacagtgctttg

SEQ ID NO: 1586 - DNA, 80 bp, Homo sapiens
ggaaaatggacgtgtgtctcatggtagccgcagtttaagtaaacataaactctgaaccagagatcatacccgccatttcc

SEQ ID NO: 1587 - DNA, 90 bp, Homo sapiens
gatagatggctttgctggtcatgctataaataaccaccaggtgccactcagagatggtggaagcctcattttgcatgacagccattgatc

SEQ ID NO: 1588 - DNA, 87 bp, Homo sapiens
cttatagaagcagattctccccacgtgtaagctactccctggggagtaatttatgcaaagagaacctttgacttaatattatataag

SEQ ID NO: 1589 - DNA, 84 bp, Homo sapiens
tgcctgctctggccagaaccaaagcacgtgtcagcttttttatttagggcaagaggtgcagaatggactgggccagtccaggca

SEQ ID NO: 1590 - DNA, 78 bp, Homo sapiens
ctcatcaggaagcacttcaaagaagtgcttttaaatgttcaaatataaatgtactttgatgaccttccttttattgag

SEQ ID NO: 1591 - DNA, 87 bp, Homo sapiens
ggctctccgtccagcagaacaagccctccctgtctgtcaccaaacagtcaggacggcctgttccacctggcaggctggactattgcc

SEQ ID NO: 1592 - DNA, 80 bp, Homo sapiens
ggcgcccgccgggctgtccggagcggccgatggggcccgtgtgagcgcgcccaggcccggcccggtgcccggcgggcggc

SEQ ID NO: 1593 - DNA, 81 bp, Homo sapiens
taagtaaattcaactaaaaatgattatgtgtcaaagtgtatagtttttacattgacatttcacataatctgactttgctta

SEQ ID NO: 1594 - DNA, 84 bp, Homo sapiens
ttaaattcttctacactgataaatataatcaatcaacagagaacatgctctgaggaattaattgttgtcagttgatgtatttaa

SEQ ID NO: 1595 - DNA, 87 bp, Homo sapiens
atgtgactttcatttcccctccaaatccaagccagctgagggaattggatttcagctgtggttggagtgctggagatggtatcgcat

SEQ ID NO: 1596 - DNA, 87 bp, Homo sapiens
ggtgctgagctggaaagggactgattgtagcaggaatgaaagaataggattcacattataatcagttctgctgagcagctgagcact

SEQ ID NO: 1597 - DNA, 90 bp, Homo sapiens
ttttacacattgtcagctgcatctattaattttcttactgtcagagacagttaagggagcctttgtggaaacatctgaggatttgtaaaa

SEQ ID NO: 1598 - DNA, 83 bp, Homo sapiens
taacaaatagctttttagttttgctttgtcatctatttcttcctgatggagacgaggaaaatattcttgaaaagcagctgtta

SEQ ID NO: 1599 - DNA, 68 bp, Homo sapiens
tagccggctctgctccaaaattcctgaaagagtgaatctggcagaattcagagtagggctaagggttg

SEQ ID NO: 1600 - DNA, 76 bp, Homo sapiens
gctgagtagcagtgaactcaggagctggagcagaccattcaccctgaaattcctccttggtcactgccttttcagc

SEQ ID NO: 1601 - DNA, 84 bp, Homo sapiens
ttccagctatttagtaactcttccaaaacactgtcagcacccatgctaggatgcagggagtgggaaggaagtctaagtagggaa

SEQ ID NO: 1602 - DNA, 88 bp, Homo sapiens
tgaatagcaacttcagaagagagccctattcattgaacaagttggtgaataaaatttggggaaaattaagtctctcaagtgctgatca

SEQ ID NO: 1603 - DNA, 76 bp, Homo sapiens
agcttctggtttgctttgtcaaatttagaaccacttgaacatcgtggtttctaaatttagtcaaaccctttgagct

SEQ ID NO: 1604 - DNA, 87 bp, Homo sapiens
gttctccttggaactcagagcacatagtgactcctttttccttttgtggtcaggaaatgagttttgctctgtttttcacttgggggc

SEQ ID NO: 1605 - DNA, 73 bp, Homo sapiens
tataagtacttgaaagtattttatggatcaatgaaatattaatggacctggaggtgctttaagtttatttata

SEQ ID NO: 1606 - DNA, 80 bp, Homo sapiens
tggtaacacggttgactgaaccacagccatgaaagtgagcttccagctcttctgctgttgcaccatagtcaacattgcca

SEQ ID NO: 1607 - DNA, 86 bp, Homo sapiens
tttgacttgtaatggcagcgtagatgacagcagagccagtgaaccacaattcagtggcttgtttgctttcaactgtcaatgtcaaa

SEQ ID NO: 1608 - DNA, 73 bp, Homo sapiens
atgattatttacttgcttataaataacactgtaatttgcataaatacagacagaataggcaactaagaatcat

SEQ ID NO: 1609 - DNA, 90 bp, Homo sapiens
ctgacgtctctgagctggccatctacactctcctcctgaattaatacagggtttggggtgacctggaaggtcaactcttaagataattag

SEQ ID NO: 1610 - DNA, 87 bp, Homo sapiens
gctggaagtcagcctctttcaaagctgtccactgggatgtacccagtgcaggagctaaatatagaaagggctccctcctcccccagc

SEQ ID NO: 1611 - DNA, 69 bp, Homo sapiens
gcatcattagctaacacagggaaagtgaaatgctgttaacttttctttttcttctgcaagctgatgagc

SEQ ID NO: 1612 - DNA, 84 bp, Homo sapiens
tcttttgcatagctattgtcttaacgtatttctggctattaggcatttgtctatttttggtcagtgaggcatgcatgctaaaga

SEQ ID NO: 1613 - DNA, 88 bp, Homo sapiens
ggaaatattaaaatagaattaatttaactaaacaaatacaactgggagagtcagtacgatttgtttagaagttactaaatttattttc

SEQ ID NO: 1614 - DNA, 88 bp, Homo sapiens
gctataatggaaaactgatggcttttatctccccaactttatgactattgatgggatagaggctgaggtttgatgaccatttaatagc

SEQ ID NO: 1615 - DNA, 87 bp, Homo sapiens
cagtgctcatctttggccagatttagcataaacagactataaatacaatggaaacctatgcaactaaaactgactaaaactgcactg

SEQ ID NO: 1616 - DNA, 89 bp, Homo sapiens
ctaacagtatatggaaggaaatttttcaaattaatttttagtgcacattgttgcttctgagagtttttgtttaatttttatagtgttag

SEQ ID NO: 1617 - DNA, 77 bp, Homo sapiens
ccttttgagtggacctgaagggttttgacctccttcaggaaaggcaaggcaaaaaccttaaaacagttccactgagg

SEQ ID NO: 1618 - DNA, 70 bp, Homo sapiens
agacagctgcagtagtttagcttacagggaaacatagaatgtcattttcaaggtaagtatgcagctgtct

SEQ ID NO: 1619 - DNA, 87 bp, Homo sapiens
aggcaagtacatgcccagtgattttaaagtgcttgaaaacaattagttttcttaagtaggttaaatatctgggttacaagcttgttt

SEQ ID NO: 1620 - DNA, 85 bp, Homo sapiens
gtcctttaagacagtggttctaaaaatgtgagccgaggatcttttggcttgcagcattaatctccacagtatgtactttaagggc

SEQ ID NO: 1621 - DNA, 79 bp, Homo sapiens
ggtgcagcttgtgtgtgattcctaacgtcatgttggctgagagccagcctggttttatttcactgtgtcaaattgtacc

SEQ ID NO: 1622 - DNA, 70 bp, Homo sapiens
gttagcatatagtttctttgcacccactatttatgtctgaatcatttgtcacaagagagtgtgtgctgat

SEQ ID NO: 1623 - DNA, 88 bp, Homo sapiens
aattgctttagttaaccaaccattgcaatgcaatcaaatgagatttgaaatgcaattggaaaagatctgtttggtagaaatagcaatt

SEQ ID NO: 1624 - DNA, 87 bp, Homo sapiens
cagtgcgccctcactaataaattctgagggctgacactgcctgagccggctggtctttgccctcaatttcattgagatgggccattg

SEQ ID NO: 1625 - DNA, 80 bp, Homo sapiens
ctctctaacgagtttaagcacaataaggcctctgaaaatatcgaggcattttgcagctgccttaaattctacctagggag

SEQ ID NO: 1626 - DNA, 72 bp, Homo sapiens
gttattttatctgttaaaagtcattatacagttttgaatgttatgtagtttctttttaacagtttaggtaat

SEQ ID NO: 1627 - DNA, 77 bp, Homo sapiens
tgctctatttgtagaaatgactgctgatgtgatgagatgcttttattatatcagtgacttttattataaataggata

SEQ ID NO: 1628 - DNA, 75 bp, Homo sapiens
cctgcctgaatgcaaccttcaacttcaaagtaatgcagtttttactaaaggatgtaggagtgaagtacaggtagg

SEQ ID NO: 1629 - DNA, 90 bp, Homo sapiens
cctcgcttaagctggtaccttcatctcagtgagctcagccctaaactctctgggtcttagctggattaagggcctaggttgttgctgagg

SEQ ID NO: 1630 - DNA, 81 bp, Homo sapiens
tgcagcagaacagtctggggccatttagcttaggggcaaatagttcctcatacttcaaagagccctaaggacattgctgca

SEQ ID NO: 1631 - DNA, 74 bp, Homo sapiens
ttattatgcaacatctgctctgaatttcaaatgtgataaacagagtatgagtgtcggtggcagatggctaatga

SEQ ID NO: 1632 - DNA, 70 bp, Homo sapiens
attttatctcaggaggagggtacaccatcagtttacacattgattgcagccactcttccagagggagaat

SEQ ID NO: 1633 - DNA, 71 bp, Homo sapiens
gaatatttactgacaggcggttaagcaaaacagccactctgctgtttgtcttttcactgtcctgaatattt

SEQ ID NO: 1634 - DNA, 89 bp, Homo sapiens
tacttttagtataatggatttttaagggaaaatattccatgaaagcattgagtattgaatattttatttgaaagcaaatgctaaaagta

SEQ ID NO: 1635 - DNA, 71 bp, Homo sapiens
gccttgctattgagatcaggatcatgggattgaacccttcatgggtcagttggctttgtttcatgcatggc

SEQ ID NO: 1636 - DNA, 89 bp, Homo sapiens
agtttactctagtttctcttctgctttcaaggctccagacccagttcctggacctgccctggaaaagaagtatcccgtagagatgagct

SEQ ID NO: 1637 - DNA, 70 bp, Homo sapiens
agtaattacaaaactgatctcttaaattctaaatgtttagtgagcatcagcgattttgcctctaattgct

SEQ ID NO: 1638 - DNA, 76 bp, Homo sapiens
gcataattgaaagcactgactctaggccatttcacccttgggaaggaatgatgaagtcagggcttctaataattgc

SEQ ID NO: 1639 - DNA, 87 bp, Homo sapiens
gctgtgctttgttctttaatgttcctagcctggatctccagccgagaccactttataacataaacggcaaagtaccattttcacagc

SEQ ID NO: 1640 - DNA, 84 bp, Homo sapiens
cttggcctgggctcagggcggattggtggagaaaatgtcgcattcaattaaggctgattggccctgacagttgtctgggtgaag

SEQ ID NO: 1641 - DNA, 73 bp, Homo sapiens
gaaggttaccaaaatccatgtaatttacccaagaaatgagtctactgggtaaatacatattgaggcaattttt

SEQ ID NO: 1642 - DNA, 73 bp, Homo sapiens
tggggctgattggcctcaggctgtggtgcccagttacctgctggtcacttcaggcttcaggcctcaggcctca

SEQ ID NO: 1643 - DNA, 70 bp, Homo sapiens
taattttttccaaaatcctgaactttatatatgagagagtgtaaaaggatcactggaaaggaagaagtta

SEQ ID NO: 1644 - DNA, 75 bp, Homo sapiens
aggggtggggaagtctggtgagggacagccttgagtcaaaggatggtcaccgctccatgtggctgccccacccct

SEQ ID NO: 1645 - DNA, 88 bp, Homo sapiens
gtgctgacaaacaagtgaatcactttattaatgtgctataaaaggataaatgaggcttgagaaactttgtttgccctagactcagcac

SEQ ID NO: 1646 - DNA, 85 bp, Homo sapiens
gtcaaattaatttgtcaaaaacatttctacagtttgtcactggacactgtattttctgacaagttaagcttaaaataaaattgac

SEQ ID NO: 1647 - DNA, 78 bp, Homo sapiens
tgaagaattgtgggtttgtaggttaattttctttgaacagctacaaagttctttttctataaatcccaattagtttca

SEQ ID NO: 1648 - DNA, 84 bp, Homo sapiens
gagctgctttgaattgctcgcagtttgccggaggcggtgtgctgggttggacgctccgggaaacaaagcaacccaaaacagctc

SEQ ID NO: 1649 - DNA, 86 bp, Homo sapiens
catttgcttgattaattactgctctgaaacccttgaaaacagacatggtctgtaagtggtatctgttgtttaatcgaggacagatg

SEQ ID NO: 1650 - DNA, 86 bp, Homo sapiens
gaaaaggatgtcatgctgtaatttgttttgtgaattctataaaccacagaacatttacttacagtaatgtttgacctttctttttc

SEQ ID NO: 1651 - DNA, 89 bp, Homo sapiens
gttttctgctttgggaatgttaccaagacttaaaaggcatttgaagaaaccaacaaacttagaaatcacattccaaaagagtagagaat

SEQ ID NO: 1652 - DNA, 72 bp, Homo sapiens
tagggatgtgattaaatgagtctcccagtgacttggtgtcgcaggagaaatcttttaatttgtacgctccta

SEQ ID NO: 1653 - DNA, 87 bp, Homo sapiens
ttattccagggagactctgtaatagataccagcattttagtaatgatacaagcaatctgtaagctattacagttttctttagagtaa

SEQ ID NO: 1654 - DNA, 77 bp, Homo sapiens
ttttgaaaggacactgcctggaaattcaattgcaggaaaaagtaattacattttctcttcaggtgtgcctctcaaaa

SEQ ID NO: 1655 - DNA, 84 bp, Homo sapiens
tcaggaaaggtcatgggaaaaatgctgtagaattttctaatggttcatccatcaaaaatgcagctctccattgattcttcccga

SEQ ID NO: 1656 - DNA, 87 bp, Homo sapiens
gcttgtcctaaaagatcttccttctgtttccctgggtttatccacttggttggcctgatgggagcaggaggcggtgagggggcgggc

SEQ ID NO: 1657 - DNA, 77 bp, Homo sapiens
atattcatgagcgtaacaccaggagagcagccaaggccccacttgagctgcttttattgtttgtctaaagtggatgt

SEQ ID NO: 1658 - DNA, 75 bp, Homo sapiens
acagacttcattgacataaagtaagacatttttaggttacttctaattcaagtttttaattgttaatgaatctgt

SEQ ID NO: 1659 - DNA, 89 bp, Homo sapiens
caataacagagattgttcacaattatgaatggttttggttgacttcagctccaacaaaaccatgaatcatttcataacttctgaaattg

SEQ ID NO: 1660 - DNA, 88 bp, Homo sapiens
ggtgtgagctgcagattcgtggcctgtctgtggcagatgccggggagtactcgtgcgtgtgtgggcaggagaggacctcagccacact

SEQ ID NO: 1661 - DNA, 85 bp, Homo sapiens
gccttgctgtatttcttataccatttattaaaaagctgctttcacggtaaaattatgttggtttgaaaggaggaaatagcaaggt

SEQ ID NO: 1662 - DNA, 76 bp, Homo sapiens
tatgatgaattttaatattctgatatcctcagctttccagtcgctcttgatttcatgaatatttaattttgtcatg

SEQ ID NO: 1663 - DNA, 84 bp, Homo sapiens
gtgcttttctttccccccaaagaagtcataccaggtatatatagagagatctataatgcccttctgttgggggaatgaaagcac

SEQ ID NO: 1664 - DNA, 85 bp, Homo sapiens
tttaaggtgcattagaggtgtttggaattgaagacaagggtctgtaaagataatatattattctagacttcattgcttccttaaa

SEQ ID NO: 1665 - DNA, 86 bp, Homo sapiens
agcaagctggggagcccagataaatagagctttctgtttcctttcctggagtctaaaatatctgatctggaggttccctccctgct

SEQ ID NO: 1666 - DNA, 89 bp, Homo sapiens
gaaagtgtcgggccttttgaaattgtcagagaaactgattttcttgtcaagtctcatcctgtacagttggagggccaaattctactttc

SEQ ID NO: 1667 - DNA, 88 bp, Homo sapiens
ctggcccattttcattctgcataaaattttaatggtctctctggctgatccgggacggcagcgcgcggagaggctcttaaagggccag

SEQ ID NO: 1668 - DNA, 86 bp, Homo sapiens
gagttatccatggtgtggtccagtgaaaagcaagaggaagaaaaatgattctgctgtttccaatctgggaaagccactgggtgctt

SEQ ID NO: 1669 - DNA, 83 bp, Homo sapiens
tgttttcttggactctgtttttcttgatagaaattttgccagaatttcactaatttaattaaaaacatcaatccattagaaca

SEQ ID NO: 1670 - DNA, 80 bp, Homo sapiens
cttgtatttgttgacatcctgatttataaaaacctgaacaagttcagtttcaataattctttttgttcaaggaacacaag

SEQ ID NO: 1671 - DNA, 81 bp, Homo sapiens
ccaggagaaatcaggtatcttggcagtgtgaccaccatgaataaacaacaactctggtggcctgtcttctgcatcttctgg

SEQ ID NO: 1672 - DNA, 80 bp, Homo sapiens
ggccctctcgcgctgaacagcatcggtctctatggcgacctgaaaccgcagctcccattggcctgttcaatatgagggcc

SEQ ID NO: 1673 - DNA, 76 bp, Homo sapiens
tcttgaaaatgagcccagttgtcatgtacagtaaattgtaatacccaaattctttgtaaattgggcagtttcaaga

SEQ ID NO: 1674 - DNA, 88 bp, Homo sapiens
gctggtggcagccatggctggccgggcatccacaatgaagagttggatgttgctgatcctgtggctgtggttaaatttctgcaccagc

SEQ ID NO: 1675 - DNA, 88 bp, Homo sapiens
gcagcataatggccagccagtgtgaaactgtgcaaattgcctcataaataactcgtaatgcacaggcaacagggagaggccatagctc

SEQ ID NO: 1676 - DNA, 79 bp, Homo sapiens
gctgagctcttacaacaggaagcttgattaaaagtgaaaggaaaaatttatcagttgtctcagcactgtagagttcagt

SEQ ID NO: 1677 - DNA, 76 bp, Homo sapiens
agagtaattataatagagtttaatgaagtttgaaactatggtattttatattagcgaatgtgttataattaactct

SEQ ID NO: 1678 - DNA, 86 bp, Homo sapiens
gctgtcagggagcctcatattttactctagtctcctaacctcacaaatcttgaggctggcactgaagtcaatgagccctctgcagc

SEQ ID NO: 1679 - DNA, 76 bp, Homo sapiens
ggttttaatgagctgctgtttcttttgacatttggaaatctaatctggaaaaatgattcaatgacttgttaagacc

SEQ ID NO: 1680 - DNA, 81 bp, Homo sapiens
accatctgtagaggaaacacagaatttggtttcatttccaaacaaacttttgaagagcaaattgttttttctgtgggaggt

SEQ ID NO: 1681 - DNA, 81 bp, Homo sapiens
atagatcctgttatgtggaaagagtcaattaattcacactttgatctaataacataggctccatccttggacaggatttat

SEQ ID NO: 1682 - DNA, 71 bp, Homo sapiens
tggcaagtgaaagaaaacagcacacactgctaatattttggtagatttgtgtgtttattctagcactgtta

SEQ ID NO: 1683 - DNA, 75 bp, Homo sapiens
cggtgacccaggcgctgcaggacacctgccccaaggcattctcagctaggcaggtgtaggtgccatggtcctccg

SEQ ID NO: 1684 - DNA, 78 bp, Homo sapiens
ttagaatgttttatcttggcaacattatttggttcccagaacacaaattaaatgcatgcttaaagcagaatattttaa

SEQ ID NO: 1685 - DNA, 78 bp, Homo sapiens
caagaaggtccttatttaacagtcctgaacgtgccaagtaccttggtaatttaattaagggagtaaaaaggatacttg

SEQ ID NO: 1686 - DNA, 82 bp, Homo sapiens
tgactgtggtaaatggtctttaaggtaaggtgctgcaacaagtacctttaaataaaatcaaataaaaagtttaccacaatca

SEQ ID NO: 1687 - DNA, 88 bp, Homo sapiens
ggtgatgaatgacctcaggttgttacaaggctaagaaacaaggagctctgtctgcctgcctgtaaataaagtgtggacatatatcacc

SEQ ID NO: 1688 - DNA, 78 bp, Homo sapiens
gagctgcacagacagctgcaattcatgggcgacgctgattgccagaaacgctatggattggcatggggtctgcagctc

SEQ ID NO: 1689 - DNA, 70 bp, Homo sapiens
ggagagattgcatcagagccatcagcttcataaatcctcctctggggactggtgtttggatgcgctttcc

SEQ ID NO: 1690 - DNA, 76 bp, Homo sapiens
gtgtgttagttccaagcttacactcactgtctgtataccctcagagagactgggttaaagtgcagagctagcagac

SEQ ID NO: 1691 - DNA, 70 bp, Homo sapiens
acagcacttgtataaggcttttaatctctaaatgcaaagcattgctattaaaatatttgtgcatgactgt

SEQ ID NO: 1692 - DNA, 81 bp, Homo sapiens
ataatgaataaatcaatcaatgaggcaagttaaacttcttttgaaattttgaagcctgattgaattgtcaaaaagaattat

SEQ ID NO: 1693 - DNA, 75 bp, Homo sapiens
caggcattgcctggctcagagacctttgctgctgagcaaactgagttaacaaagtgggctgaggggtgaagcctg

SEQ ID NO: 1694 - DNA, 85 bp, Homo sapiens
agcaaaggaaccctatttctcttatggtaatgtaatagtaatttttaaaataactacaatacatatgatagaaatggcatttgct

SEQ ID NO: 1695 - DNA, 23 bp, Homo sapiens
  mature of SEQ ID 1
cttgttactgtctattaagcctc

SEQ ID NO: 1696 - DNA, 21 bp, Homo sapiens
  mature of SEQ ID 2
agctgatttgttatgtttaaa

SEQ ID NO: 1697 - DNA, 33 bp, Homo sapiens
  mature of SEQ ID 3
ggggaaagtttggagccggcgaggggcgccggg

SEQ ID NO: 1698 - DNA, 31 bp, Homo sapiens
  mature of SEQ ID 3
ggagttggggaaagtttggagccggcgaggg

SEQ ID NO: 1699 - DNA, 34 bp, Homo sapiens
  mature of SEQ ID 4
tgattcatttcatagctattaaagtgttaacagt

SEQ ID NO: 1700 - DNA, 27 bp, Homo sapiens
  mature of SEQ ID 5
gcacctcctccaggggatgaatctcat

SEQ ID NO: 1701 - DNA, 19 bp, Homo sapiens
  mature of SEQ ID 6
agaagccaaaacagagact

SEQ ID NO: 1702 - DNA, 24 bp, Homo sapiens
  mature of SEQ ID 7
cattatggaaactcttgtgctggc

SEQ ID NO: 1703 - DNA, 33 bp, Homo sapiens
  mature of SEQ ID 7
attgaatttacagtaaaggttttatggggcttt

SEQ ID NO: 1704 - DNA, 31 bp, Homo sapiens
  mature of SEQ ID 7
cagtttattgaatttacagtaaaggttttat

SEQ ID NO: 1705 - DNA, 19 bp, Homo sapiens
  mature of SEQ ID 8
ggcggaaggcagctgagtt

SEQ ID NO: 1706 - DNA, 20 bp, Homo sapiens
  mature of SEQ ID 9
catattcctctgacaacctt

SEQ ID NO: 1707 - DNA, 28 bp, Homo sapiens
  mature of SEQ ID 9
ggatcatgaaacagtatgttgaaattgg

SEQ ID NO: 1708 - DNA, 28 bp, Homo sapiens
  mature of SEQ ID 10
aaaaattgtaatttattgaaactcaact

SEQ ID NO: 1709 - DNA, 33 bp, Homo sapiens
  mature of SEQ ID 12
cacgcgtgcgcctaattggctccacgtgtctgc

SEQ ID NO: 1710 - DNA, 30 bp, Homo sapiens
  mature of SEQ ID 12
gcgcccacgcgtgcgcctaattggctccac

SEQ ID NO: 1711 - DNA, 19 bp, Homo sapiens
  mature of SEQ ID 12
gccgcaatcagggagaaaa

SEQ ID NO: 1712 - DNA, 24 bp, Homo sapiens
  mature of SEQ ID 13
taacaggaagtaacatagttctag

SEQ ID NO: 1713 - DNA, 20 bp, Homo sapiens
  mature of SEQ ID 13
tttgatcatacaaatgcaaa

SEQ ID NO: 1714 - DNA, 26 bp, Homo sapiens
  mature of SEQ ID 14
agctttcattactgtgtacatcaagt

SEQ ID NO: 1715 - DNA, 32 bp, Homo sapiens
  mature of SEQ ID 14
ctattgatgtatcaactataatagttacaagc

SEQ ID NO: 1716 - DNA, 34 bp, Homo sapiens
  mature of SEQ ID 14
tgtatcaactataatagttacaagcagctacaga

SEQ ID NO: 1717 - DNA, 19 bp, Homo sapiens
  mature of SEQ ID 15
gttaattgaagctttgatg

SEQ ID NO: 1718 - DNA, 33 bp, Homo sapiens
  mature of SEQ ID 15
ttctattcttatcagagttttgcaagagggttg

SEQ ID NO: 1719 - DNA, 24 bp, Homo sapiens
  mature of SEQ ID 16
cctcaaatctgcaattcatgtatg

SEQ ID NO: 1720 - DNA, 35 bp, Homo sapiens
  mature of SEQ ID 16
caaggatgacatagatttgacaaaaaattaatgat

SEQ ID NO: 1721 - DNA, 33 bp, Homo sapiens
  mature of SEQ ID 16
ggcatacacaaggatgacatagatttgacaaaa

SEQ ID NO: 1722 - DNA, 20 bp, Homo sapiens
  mature of SEQ ID 17
tgctcacttgactgacaggt

SEQ ID NO: 1723 - DNA, 33 bp, Homo sapiens
  mature of SEQ ID 17
atgaaatgcaataggtcaaagaaggaatgagca

SEQ ID NO: 1724 - DNA, 21 bp, Homo sapiens
  mature of SEQ ID 18
tgtcagtcatcatcagtcagt

SEQ ID NO: 1725 - DNA, 30 bp, Homo sapiens
  mature of SEQ ID 19
taggtcattagctgcctctgataaccattt

SEQ ID NO: 1726 - DNA, 23 bp, Homo sapiens
  mature of SEQ ID 20
tctgaatgttggtggcaatatag

SEQ ID NO: 1727 - DNA, 25 bp, Homo sapiens
  mature of SEQ ID 20
tttctaacaaagctgccctccctgc

SEQ ID NO: 1728 - DNA, 23 bp, Homo sapiens
  mature of SEQ ID 21
aggagaaacatcagtttataatt

SEQ ID NO: 1729 - DNA, 23 bp, Homo sapiens
  mature of SEQ ID 21
cacctgtgtaaattgtgtatttc

SEQ ID NO: 1730 - DNA, 31 bp, Homo sapiens
  mature of SEQ ID 22
agaaaaaccttgggttagacctacagggggt

SEQ ID NO: 1731 - DNA, 34 bp, Homo sapiens
  mature of SEQ ID 22
accttgggttagacctacagggggtctggctggt

SEQ ID NO: 1732 - DNA, 28 bp, Homo sapiens
  mature of SEQ ID 22
tgtttccagcattcccaggtaggccaag

SEQ ID NO: 1733 - DNA, 21 bp, Homo sapiens
  mature of SEQ ID 23
aaaacactgtggagctgttca

SEQ ID NO: 1734 - DNA, 24 bp, Homo sapiens
  mature of SEQ ID 24
atggcaaagagacctataaagaaa

SEQ ID NO: 1735 - DNA, 21 bp, Homo sapiens
  mature of SEQ ID 25
tgagtttaattaaaagaaatc

SEQ ID NO: 1736 - DNA, 25 bp, Homo sapiens
  mature of SEQ ID 25
gttccttatggagtttgaaatttag

SEQ ID NO: 1737 - DNA, 19 bp, Homo sapiens
  mature of SEQ ID 27
ggtctcctgctctgctgat

SEQ ID NO: 1738 - DNA, 32 bp, Homo sapiens
  mature of SEQ ID 27
tcctgagggatctgggacaacaggtggtggac

SEQ ID NO: 1739 - DNA, 27 bp, Homo sapiens
  mature of SEQ ID 28
gtgcagctgtaattttaacaaggggaa

SEQ ID NO: 1740 - DNA, 19 bp, Homo sapiens
  mature of SEQ ID 28
gggttgatatactgtacca

SEQ ID NO: 1741 - DNA, 34 bp, Homo sapiens
  mature of SEQ ID 30
aatgaagagtcagcaaatgagcaggtttccattt

SEQ ID NO: 1742 - DNA, 28 bp, Homo sapiens
  mature of SEQ ID 31
gtgaaatcaaattaggaaatgggaggag

SEQ ID NO: 1743 - DNA, 21 bp, Homo sapiens
  mature of SEQ ID 31
ctctaattctgacttcattgc

SEQ ID NO: 1744 - DNA, 31 bp, Homo sapiens
  mature of SEQ ID 32
gcaggagcctcctctggcttgagccctttct

SEQ ID NO: 1745 - DNA, 33 bp, Homo sapiens
  mature of SEQ ID 32
gcctcctctggcttgagccctttcttggtaagt

SEQ ID NO: 1746 - DNA, 31 bp, Homo sapiens
  mature of SEQ ID 34
caaaagtggctgttcattttgttatctgacc

SEQ ID NO: 1747 - DNA, 19 bp, Homo sapiens
  mature of SEQ ID 35
atgggtcagaaggactcct

SEQ ID NO: 1748 - DNA, 20 bp, Homo sapiens
  mature of SEQ ID 35
gcccagagcaagagaggcat

SEQ ID NO: 1749 - DNA, 22 bp, Homo sapiens
  mature of SEQ ID 36
tctgacacttgtctaaatcctg

SEQ ID NO: 1750 - DNA, 20 bp, Homo sapiens
  mature of SEQ ID 36
aagggcaaagggcacagatc

SEQ ID NO: 1751 - DNA, 34 bp, Homo sapiens
  mature of SEQ ID 37
ggaatctggtttgaaaattggacattaagttaca

SEQ ID NO: 1752 - DNA, 32 bp, Homo sapiens
  mature of SEQ ID 38
gatgttgatgtctactagatggagcagaaata

SEQ ID NO: 1753 - DNA, 34 bp, Homo sapiens
  mature of SEQ ID 38
atgtctactagatggagcagaaataattaatgtt

SEQ ID NO: 1754 - DNA, 24 bp, Homo sapiens
  mature of SEQ ID 39
ccagggcccctagtgtgaaggaat

SEQ ID NO: 1755 - DNA, 31 bp, Homo sapiens
  mature of SEQ ID 39
gttctaactttaggtggctacgtggctgatg

SEQ ID NO: 1756 - DNA, 21 bp, Homo sapiens
  mature of SEQ ID 40
gctgtattgcttatgtaccac

SEQ ID NO: 1757 - DNA, 20 bp, Homo sapiens
  mature of SEQ ID 41
ttaactgtccccaagtacag

SEQ ID NO: 1758 - DNA, 19 bp, Homo sapiens
  mature of SEQ ID 42
tgctcaggtcacagctggg

SEQ ID NO: 1759 - DNA, 32 bp, Homo sapiens
  mature of SEQ ID 43
gctgagaaataatttaaagggtagtaaatgaa

SEQ ID NO: 1760 - DNA, 20 bp, Homo sapiens
  mature of SEQ ID 45
agagagtgacagctgtgtgg

SEQ ID NO: 1761 - DNA, 19 bp, Homo sapiens
  mature of SEQ ID 46
tctggagagtctttgtaaa

SEQ ID NO: 1762 - DNA, 26 bp, Homo sapiens
  mature of SEQ ID 47
caagaagaaaccaatacataattgga

SEQ ID NO: 1763 - DNA, 19 bp, Homo sapiens
  mature of SEQ ID 48
tttgggcaaacattggcac

SEQ ID NO: 1764 - DNA, 24 bp, Homo sapiens
  mature of SEQ ID 49
gttgtgttgtcatggtaaccctat

SEQ ID NO: 1765 - DNA, 22 bp, Homo sapiens
  mature of SEQ ID 50
atggcctttaaacagtgtctgc

SEQ ID NO: 1766 - DNA, 32 bp, Homo sapiens
  mature of SEQ ID 51
tgccctaaaggtgccaggtaaagagaattgcc

SEQ ID NO: 1767 - DNA, 30 bp, Homo sapiens
  mature of SEQ ID 51
tgctttgccctaaaggtgccaggtaaagag

SEQ ID NO: 1768 - DNA, 33 bp, Homo sapiens
  mature of SEQ ID 52
ttgttacatagctaacttattttctaatagact

SEQ ID NO: 1769 - DNA, 30 bp, Homo sapiens
  mature of SEQ ID 52
tcaatttgttacatagctaacttattttct

SEQ ID NO: 1770 - DNA, 26 bp, Homo sapiens
  mature of SEQ ID 52
ggtaataagaaaatgaattacatgct

SEQ ID NO: 1771 - DNA, 24 bp, Homo sapiens
  mature of SEQ ID 53
cagcgaatctgggcttggttccac

SEQ ID NO: 1772 - DNA, 31 bp, Homo sapiens
  mature of SEQ ID 53
gcaggcccctttaacgtggcaagtctaagaa

SEQ ID NO: 1773 - DNA, 34 bp, Homo sapiens
  mature of SEQ ID 53
ccctttaacgtggcaagtctaagaaatgtcggcc

SEQ ID NO: 1774 - DNA, 29 bp, Homo sapiens
  mature of SEQ ID 54
ctgtaacacaatggagcatgattaatgag

SEQ ID NO: 1775 - DNA, 23 bp, Homo sapiens
  mature of SEQ ID 55
tggttccaggtgttgctgtcttc

SEQ ID NO: 1776 - DNA, 30 bp, Homo sapiens
  mature of SEQ ID 56
acaatatattaactgcctaatttaaaaata

SEQ ID NO: 1777 - DNA, 26 bp, Homo sapiens
  mature of SEQ ID 56
tttatgaagggcaattaaccactaag

SEQ ID NO: 1778 - DNA, 24 bp, Homo sapiens
  mature of SEQ ID 57
gcttagaaaacacttaatctattt

SEQ ID NO: 1779 - DNA, 32 bp, Homo sapiens
  mature of SEQ ID 58
caggcggcggcccagctaaagttcacagcgcc

SEQ ID NO: 1780 - DNA, 30 bp, Homo sapiens
  mature of SEQ ID 58
gctgacaggcggcggcccagctaaagttca

SEQ ID NO: 1781 - DNA, 35 bp, Homo sapiens
  mature of SEQ ID 58
cggaggctggcgcgggctgctgcacctttaacgct

SEQ ID NO: 1782 - DNA, 33 bp, Homo sapiens
  mature of SEQ ID 58
ggcggctgcggaggctggcgcgggctgctgcac

SEQ ID NO: 1783 - DNA, 23 bp, Homo sapiens
  mature of SEQ ID 59
ctgggactgattagccgtggtgc

SEQ ID NO: 1784 - DNA, 29 bp, Homo sapiens
  mature of SEQ ID 60
tgagacctggaagccacagcactggtgga

SEQ ID NO: 1785 - DNA, 31 bp, Homo sapiens
  mature of SEQ ID 60
tctactgcctgctgctccagatccaagggga

SEQ ID NO: 1786 - DNA, 28 bp, Homo sapiens
  mature of SEQ ID 61
tagatcttatagcaaactaaaaacagaa

SEQ ID NO: 1787 - DNA, 21 bp, Homo sapiens
  mature of SEQ ID 62
aatttgatgtagtctagacaa

SEQ ID NO: 1788 - DNA, 25 bp, Homo sapiens
  mature of SEQ ID 63
ggcttcacaaagtggccctgggcat

SEQ ID NO: 1789 - DNA, 34 bp, Homo sapiens
  mature of SEQ ID 64
gtaatggagtagaatgttgcagtttgtgagttta

SEQ ID NO: 1790 - DNA, 31 bp, Homo sapiens
  mature of SEQ ID 64
gattatatgccagatgttcaaactatctcta

SEQ ID NO: 1791 - DNA, 33 bp, Homo sapiens
  mature of SEQ ID 64
atgccagatgttcaaactatctctaatcattgc

SEQ ID NO: 1792 - DNA, 33 bp, Homo sapiens
  mature of SEQ ID 65
ctttaattcttgttttaaataaataatgagaac

SEQ ID NO: 1793 - DNA, 30 bp, Homo sapiens
  mature of SEQ ID 65
tgttgctttaattcttgttttaaataaata

SEQ ID NO: 1794 - DNA, 25 bp, Homo sapiens
  mature of SEQ ID 65
taatatttatgctaagaggattgtc

SEQ ID NO: 1795 - DNA, 32 bp, Homo sapiens
  mature of SEQ ID 66
ccttttctgtctctttgctagcctaggtggct

SEQ ID NO: 1796 - DNA, 30 bp, Homo sapiens
  mature of SEQ ID 66
tggggccttttctgtctctttgctagccta

SEQ ID NO: 1797 - DNA, 25 bp, Homo sapiens
  mature of SEQ ID 67
gtgggagacatcgggtgggggccct

SEQ ID NO: 1798 - DNA, 32 bp, Homo sapiens
  mature of SEQ ID 67
tgggcccagctggggccccctcctgcctgcct

SEQ ID NO: 1799 - DNA, 32 bp, Homo sapiens
  mature of SEQ ID 68
tgctgtatatggagaaacttctaaacattatg

SEQ ID NO: 1800 - DNA, 29 bp, Homo sapiens
  mature of SEQ ID 68
catatgctgtatatggagaaacttctaaa

SEQ ID NO: 1801 - DNA, 35 bp, Homo sapiens
  mature of SEQ ID 68
gcttatctgaaaaagctctcatttgcagcaatatg

SEQ ID NO: 1802 - DNA, 32 bp, Homo sapiens
  mature of SEQ ID 68
gtaatatgcttatctgaaaaagctctcatttg

SEQ ID NO: 1803 - DNA, 25 bp, Homo sapiens
  mature of SEQ ID 69
tatcacacataattgcactctgtgt

SEQ ID NO: 1804 - DNA, 25 bp, Homo sapiens
  mature of SEQ ID 69
cagagtcaattactcactgtgtgaa

SEQ ID NO: 1805 - DNA, 33 bp, Homo sapiens
  mature of SEQ ID 70
gaacatctatcttccatgacctcttgattactg

SEQ ID NO: 1806 - DNA, 31 bp, Homo sapiens
  mature of SEQ ID 70
agtgaagaacatctatcttccatgacctctt

SEQ ID NO: 1807 - DNA, 20 bp, Homo sapiens
  mature of SEQ ID 70
gccagagtggtctggacaca

SEQ ID NO: 1808 - DNA, 26 bp, Homo sapiens
  mature of SEQ ID 71
ggattagatggcagtctatgaaatcc

SEQ ID NO: 1809 - DNA, 30 bp, Homo sapiens
  mature of SEQ ID 73
tagcttttatgagaataaatgctttctgac

SEQ ID NO: 1810 - DNA, 32 bp, Homo sapiens
  mature of SEQ ID 74
agctcattggtaatgaaaataatcataagtca

SEQ ID NO: 1811 - DNA, 30 bp, Homo sapiens
  mature of SEQ ID 74
aattcagctcattggtaatgaaaataatca

SEQ ID NO: 1812 - DNA, 31 bp, Homo sapiens
  mature of SEQ ID 75
cattccctggactcttggcctcattagaaat

SEQ ID NO: 1813 - DNA, 31 bp, Homo sapiens
  mature of SEQ ID 76
ctttcaacgttggaagcagttgagcaagtga

SEQ ID NO: 1814 - DNA, 29 bp, Homo sapiens
  mature of SEQ ID 76
atttctttcaacgttggaagcagttgagc

SEQ ID NO: 1815 - DNA, 33 bp, Homo sapiens
  mature of SEQ ID 77
tttgttgacaaaacagtgaaatgtctagaccat

SEQ ID NO: 1816 - DNA, 30 bp, Homo sapiens
  mature of SEQ ID 77
agggctttgttgacaaaacagtgaaatgtc

SEQ ID NO: 1817 - DNA, 31 bp, Homo sapiens
  mature of SEQ ID 77
cagagatattgacatagtgagaaaacattgc

SEQ ID NO: 1818 - DNA, 29 bp, Homo sapiens
  mature of SEQ ID 77
atggcagagatattgacatagtgagaaaa

SEQ ID NO: 1819 - DNA, 21 bp, Homo sapiens
  mature of SEQ ID 78
ttttattctttccataattct

SEQ ID NO: 1820 - DNA, 23 bp, Homo sapiens
  mature of SEQ ID 78
ctggaggaataatatttttactg

SEQ ID NO: 1821 - DNA, 19 bp, Homo sapiens
  mature of SEQ ID 79
cctacctcagcatttctga

SEQ ID NO: 1822 - DNA, 34 bp, Homo sapiens
  mature of SEQ ID 80
ttcctaatatattatgtcctcccctgccgagtcc

SEQ ID NO: 1823 - DNA, 26 bp, Homo sapiens
  mature of SEQ ID 80
aagtaatataaatgttagctaagaag

SEQ ID NO: 1824 - DNA, 33 bp, Homo sapiens
  mature of SEQ ID 81
acataaagaggcagggatgctgattttagacac

SEQ ID NO: 1825 - DNA, 30 bp, Homo sapiens
  mature of SEQ ID 81
ggagtacataaagaggcagggatgctgatt

SEQ ID NO: 1826 - DNA, 31 bp, Homo sapiens
  mature of SEQ ID 81
attgtgagtgtcccttgccatatttctgcta

SEQ ID NO: 1827 - DNA, 34 bp, Homo sapiens
  mature of SEQ ID 81
agtgtcccttgccatatttctgctaatgtgtttc

SEQ ID NO: 1828 - DNA, 31 bp, Homo sapiens
  mature of SEQ ID 82
ttgacaatcaaatggagcttaaagggaatta

SEQ ID NO: 1829 - DNA, 30 bp, Homo sapiens
  mature of SEQ ID 83
ggccaggccataattaaccttttgaacttg

SEQ ID NO: 1830 - DNA, 20 bp, Homo sapiens
  mature of SEQ ID 83
agcaatcagtttcaggtttc

SEQ ID NO: 1831 - DNA, 34 bp, Homo sapiens
  mature of SEQ ID 84
gacggctttggagattatggggaacatatggccc

SEQ ID NO: 1832 - DNA, 24 bp, Homo sapiens
  mature of SEQ ID 84
ggctctttatctgcattttctcat

SEQ ID NO: 1833 - DNA, 20 bp, Homo sapiens
  mature of SEQ ID 86
ggggtcaataatgagaggaa

SEQ ID NO: 1834 - DNA, 28 bp, Homo sapiens
  mature of SEQ ID 86
ttccacattattaatgaactttgcagca

SEQ ID NO: 1835 - DNA, 34 bp, Homo sapiens
  mature of SEQ ID 87
tcttagtgctttctaattaaaaaggaggggagtg

SEQ ID NO: 1836 - DNA, 20 bp, Homo sapiens
  mature of SEQ ID 89
atttcacttgtacaaattaa

SEQ ID NO: 1837 - DNA, 32 bp, Homo sapiens
  mature of SEQ ID 90
tttaattaacttcgagatgctccggcggcggg

SEQ ID NO: 1838 - DNA, 29 bp, Homo sapiens
  mature of SEQ ID 90
ccgctttaattaacttcgagatgctccgg

SEQ ID NO: 1839 - DNA, 30 bp, Homo sapiens
  mature of SEQ ID 90
cccacgcacggagggtcgccaggaaagtgg

SEQ ID NO: 1840 - DNA, 23 bp, Homo sapiens
  mature of SEQ ID 91
accctcaagctctcaagtggtga

SEQ ID NO: 1841 - DNA, 20 bp, Homo sapiens
  mature of SEQ ID 92
agctgctgcagagggcacag

SEQ ID NO: 1842 - DNA, 29 bp, Homo sapiens
  mature of SEQ ID 93
aaacggatcgcatggctcatttatcttgc

SEQ ID NO: 1843 - DNA, 32 bp, Homo sapiens
  mature of SEQ ID 93
ggatcgcatggctcatttatcttgcagccatt

SEQ ID NO: 1844 - DNA, 30 bp, Homo sapiens
  mature of SEQ ID 94
ctctctcttgctgaactctgtgtccagggt

SEQ ID NO: 1845 - DNA, 32 bp, Homo sapiens
  mature of SEQ ID 94
tcttgctgaactctgtgtccagggttctctag

SEQ ID NO: 1846 - DNA, 20 bp, Homo sapiens
  mature of SEQ ID 94
acatggaatattcagacagt

SEQ ID NO: 1847 - DNA, 24 bp, Homo sapiens
  mature of SEQ ID 95
cttgaggaagctgtaaggtctttg

SEQ ID NO: 1848 - DNA, 33 bp, Homo sapiens
  mature of SEQ ID 96
aaattgaaaccgcagtacaatatatgtgaatga

SEQ ID NO: 1849 - DNA, 19 bp, Homo sapiens
  mature of SEQ ID 97
caaatcacatgtgggtctt

SEQ ID NO: 1850 - DNA, 27 bp, Homo sapiens
  mature of SEQ ID 97
gaataccattaatctgttcactaggag

SEQ ID NO: 1851 - DNA, 33 bp, Homo sapiens
  mature of SEQ ID 99
gggggcttttcattaacaaagtagcgggcggtg

SEQ ID NO: 1852 - DNA, 35 bp, Homo sapiens
  mature of SEQ ID 99
ttcattaacaaagtagcgggcggtgtcatcttccc

SEQ ID NO: 1853 - DNA, 29 bp, Homo sapiens
  mature of SEQ ID 100
aatcctttattaaaggtcactatttttca

SEQ ID NO: 1854 - DNA, 21 bp, Homo sapiens
  mature of SEQ ID 100
tgtgtgtctgggaaaatagtc

SEQ ID NO: 1855 - DNA, 19 bp, Homo sapiens
  mature of SEQ ID 101
tggccagatggccctgcag

SEQ ID NO: 1856 - DNA, 21 bp, Homo sapiens
  mature of SEQ ID 103
catgccagtctgaccttgcac

SEQ ID NO: 1857 - DNA, 20 bp, Homo sapiens
  mature of SEQ ID 103
ttgctggcagattacaattg

SEQ ID NO: 1858 - DNA, 24 bp, Homo sapiens
  mature of SEQ ID 104
actgtgacctttaattaacattgc

SEQ ID NO: 1859 - DNA, 32 bp, Homo sapiens
  mature of SEQ ID 107
tgtaataaaaatgtaaactcagctgtttcaca

SEQ ID NO: 1860 - DNA, 35 bp, Homo sapiens
  mature of SEQ ID 107
aaaatgtaaactcagctgtttcacagacataaaag

SEQ ID NO: 1861 - DNA, 19 bp, Homo sapiens
  mature of SEQ ID 108
ttgcagtgttttcttgcag

SEQ ID NO: 1862 - DNA, 25 bp, Homo sapiens
  mature of SEQ ID 109
aagccccatatttagggtgaccaga

SEQ ID NO: 1863 - DNA, 21 bp, Homo sapiens
  mature of SEQ ID 109
gaaatgagggctgcgtggggc

SEQ ID NO: 1864 - DNA, 32 bp, Homo sapiens
  mature of SEQ ID 111
tgttacccagagttttaaatggaatatgtaac

SEQ ID NO: 1865 - DNA, 35 bp, Homo sapiens
  mature of SEQ ID 111
cagagttttaaatggaatatgtaactgctgaggag

SEQ ID NO: 1866 - DNA, 27 bp, Homo sapiens
  mature of SEQ ID 113
agagaaagtatcttgtttggagcttgc

SEQ ID NO: 1867 - DNA, 20 bp, Homo sapiens
  mature of SEQ ID 114
ggctgaggcagtcagatgtg

SEQ ID NO: 1868 - DNA, 19 bp, Homo sapiens
  mature of SEQ ID 114
gataattacattttctgca

SEQ ID NO: 1869 - DNA, 28 bp, Homo sapiens
  mature of SEQ ID 115
ctttcattgatcaaatctgtttctagcc

SEQ ID NO: 1870 - DNA, 22 bp, Homo sapiens
  mature of SEQ ID 116
caggcttctgaattgtggccag

SEQ ID NO: 1871 - DNA, 20 bp, Homo sapiens
  mature of SEQ ID 116
acataatgaatcccatttct

SEQ ID NO: 1872 - DNA, 30 bp, Homo sapiens
  mature of SEQ ID 117
ctcgatctgtctaaacacaatttgacatgc

SEQ ID NO: 1873 - DNA, 32 bp, Homo sapiens
  mature of SEQ ID 117
tctgtctaaacacaatttgacatgcgttgcta

SEQ ID NO: 1874 - DNA, 20 bp, Homo sapiens
  mature of SEQ ID 117
tagcaccttatcaaataatg

SEQ ID NO: 1875 - DNA, 28 bp, Homo sapiens
  mature of SEQ ID 118
aaaattcaattggaaaaaatgtacttag

SEQ ID NO: 1876 - DNA, 33 bp, Homo sapiens
  mature of SEQ ID 119
ctgaaatgacatacagtaattgctttagctact

SEQ ID NO: 1877 - DNA, 31 bp, Homo sapiens
  mature of SEQ ID 120
gccgcccgcgccagcctctccatctcgcaag

SEQ ID NO: 1878 - DNA, 29 bp, Homo sapiens
  mature of SEQ ID 120
cggagccgcccgcgccagcctctccatct

SEQ ID NO: 1879 - DNA, 32 bp, Homo sapiens
  mature of SEQ ID 122
agacaggactaaaattaatggggaaagcagca

SEQ ID NO: 1880 - DNA, 25 bp, Homo sapiens
  mature of SEQ ID 123
tgtaccttataaatgtatttgaaag

SEQ ID NO: 1881 - DNA, 22 bp, Homo sapiens
  mature of SEQ ID 123
ttttaagactttattttctcac

SEQ ID NO: 1882 - DNA, 32 bp, Homo sapiens
  mature of SEQ ID 124
gatttattaatattgatttctaagctgtaaaa

SEQ ID NO: 1883 - DNA, 27 bp, Homo sapiens
  mature of SEQ ID 125
atttaattgggtgctttgtaaatagtc

SEQ ID NO: 1884 - DNA, 34 bp, Homo sapiens
  mature of SEQ ID 127
gtggccttgttcttcatttcagtgttaatcagct

SEQ ID NO: 1885 - DNA, 21 bp, Homo sapiens
  mature of SEQ ID 127
atgatgtgtgagtgaacatat

SEQ ID NO: 1886 - DNA, 19 bp, Homo sapiens
  mature of SEQ ID 128
aggtagcaaggagatgctg

SEQ ID NO: 1887 - DNA, 21 bp, Homo sapiens
  mature of SEQ ID 129
gatgaaataaataggacttaa

SEQ ID NO: 1888 - DNA, 19 bp, Homo sapiens
  mature of SEQ ID 130
agaatgtttaatgtgcttt

SEQ ID NO: 1889 - DNA, 28 bp, Homo sapiens
  mature of SEQ ID 131
aaagaatatttgtttaatagtgtcagaa

SEQ ID NO: 1890 - DNA, 19 bp, Homo sapiens
  mature of SEQ ID 131
ttttaacaccataaaaagg

SEQ ID NO: 1891 - DNA, 19 bp, Homo sapiens
  mature of SEQ ID 133
atagtaaattttctcaaat

SEQ ID NO: 1892 - DNA, 33 bp, Homo sapiens
  mature of SEQ ID 135
aacctttttatcatttatcttcttgtattaatg

SEQ ID NO: 1893 - DNA, 30 bp, Homo sapiens
  mature of SEQ ID 135
gccttaacctttttatcatttatcttcttg

SEQ ID NO: 1894 - DNA, 22 bp, Homo sapiens
  mature of SEQ ID 136
gaaaagagcatatatgattcat

SEQ ID NO: 1895 - DNA, 20 bp, Homo sapiens
  mature of SEQ ID 138
tctgcagctggatgtatccg

SEQ ID NO: 1896 - DNA, 22 bp, Homo sapiens
  mature of SEQ ID 139
cccactggagcatggagccagc

SEQ ID NO: 1897 - DNA, 23 bp, Homo sapiens
  mature of SEQ ID 139
gctggctcctgctcagagtgaca

SEQ ID NO: 1898 - DNA, 32 bp, Homo sapiens
  mature of SEQ ID 141
tgatcaggcgcttgatatgacaggctgtggga

SEQ ID NO: 1899 - DNA, 35 bp, Homo sapiens
  mature of SEQ ID 141
gcgcttgatatgacaggctgtgggagtcaggaccc

SEQ ID NO: 1900 - DNA, 25 bp, Homo sapiens
  mature of SEQ ID 141
acagagtgggccttgtctgtcacag

SEQ ID NO: 1901 - DNA, 32 bp, Homo sapiens
  mature of SEQ ID 142
attcttaccttacctcttccaaatctatctga

SEQ ID NO: 1902 - DNA, 27 bp, Homo sapiens
  mature of SEQ ID 144
catctgggataaagattaagaaagagg

SEQ ID NO: 1903 - DNA, 22 bp, Homo sapiens
  mature of SEQ ID 145
ccgccagctttgtagcggttcc

SEQ ID NO: 1904 - DNA, 28 bp, Homo sapiens
  mature of SEQ ID 146
tgtaaaacagggcttatgtttcagtttg

SEQ ID NO: 1905 - DNA, 19 bp, Homo sapiens
  mature of SEQ ID 146
cagaaaataaaaggagtgt

SEQ ID NO: 1906 - DNA, 33 bp, Homo sapiens
  mature of SEQ ID 147
ctgttgagtgggtgttggtgtgggtaacaataa

SEQ ID NO: 1907 - DNA, 33 bp, Homo sapiens
  mature of SEQ ID 147
ataatatgtgctggcagattagcacacttctct

SEQ ID NO: 1908 - DNA, 24 bp, Homo sapiens
  mature of SEQ ID 148
gctcataaaattaatttatggatg

SEQ ID NO: 1909 - DNA, 28 bp, Homo sapiens
  mature of SEQ ID 149
gtcattaaaattatgtcaaaatgtctta

SEQ ID NO: 1910 - DNA, 26 bp, Homo sapiens
  mature of SEQ ID 150
acaggaagacttcatgaaagcagtca

SEQ ID NO: 1911 - DNA, 32 bp, Homo sapiens
  mature of SEQ ID 151
agcattttaagtaggtgttataaatctctgcc

SEQ ID NO: 1912 - DNA, 30 bp, Homo sapiens
  mature of SEQ ID 151
agtgtagcattttaagtaggtgttataaat

SEQ ID NO: 1913 - DNA, 21 bp, Homo sapiens
  mature of SEQ ID 151
ggcacattcatagccctgctt

SEQ ID NO: 1914 - DNA, 31 bp, Homo sapiens
  mature of SEQ ID 152
agagggtctcctatgcctttgaggagggtga

SEQ ID NO: 1915 - DNA, 29 bp, Homo sapiens
  mature of SEQ ID 152
aaacagagggtctcctatgcctttgagga

SEQ ID NO: 1916 - DNA, 32 bp, Homo sapiens
  mature of SEQ ID 152
attttcctttaattaaggctctgtggaggtgt

SEQ ID NO: 1917 - DNA, 29 bp, Homo sapiens
  mature of SEQ ID 152
ttccattttcctttaattaaggctctgtg

SEQ ID NO: 1918 - DNA, 23 bp, Homo sapiens
  mature of SEQ ID 153
atgatggatgatcccataaggaa

SEQ ID NO: 1919 - DNA, 32 bp, Homo sapiens
  mature of SEQ ID 154
atttaatgttggaggtttgtatgaacttgaag

SEQ ID NO: 1920 - DNA, 30 bp, Homo sapiens
  mature of SEQ ID 154
tagcaatttaatgttggaggtttgtatgaa

SEQ ID NO: 1921 - DNA, 21 bp, Homo sapiens
  mature of SEQ ID 155
ttacctctaaataacttgtgc

SEQ ID NO: 1922 - DNA, 22 bp, Homo sapiens
  mature of SEQ ID 156
tgtaatatatcaacagtaatag

SEQ ID NO: 1923 - DNA, 22 bp, Homo sapiens
  mature of SEQ ID 156
gttgattactctctgtgtaatt

SEQ ID NO: 1924 - DNA, 30 bp, Homo sapiens
  mature of SEQ ID 157
ttgaatacttttctgacaaggttcctattt

SEQ ID NO: 1925 - DNA, 32 bp, Homo sapiens
  mature of SEQ ID 158
tgaactcgagttggaagaggcgagtccggtct

SEQ ID NO: 1926 - DNA, 27 bp, Homo sapiens
  mature of SEQ ID 158
gacgactggccccgcctcttcctctcg

SEQ ID NO: 1927 - DNA, 31 bp, Homo sapiens
  mature of SEQ ID 159
aatcaatgagctaataataatggtggtaatg

SEQ ID NO: 1928 - DNA, 29 bp, Homo sapiens
  mature of SEQ ID 159
ttgcaatcaatgagctaataataatggtg

SEQ ID NO: 1929 - DNA, 24 bp, Homo sapiens
  mature of SEQ ID 159
tattacctttaatcatcgacagca

SEQ ID NO: 1930 - DNA, 19 bp, Homo sapiens
  mature of SEQ ID 160
tggaatctgatgaggtggt

SEQ ID NO: 1931 - DNA, 22 bp, Homo sapiens
  mature of SEQ ID 160
agcagctggccatactggacac

SEQ ID NO: 1932 - DNA, 27 bp, Homo sapiens
  mature of SEQ ID 162
ttatcattataaaatgtgataatgtca

SEQ ID NO: 1933 - DNA, 32 bp, Homo sapiens
  mature of SEQ ID 163
gccgccttgcccagcccctgagggccccagcc

SEQ ID NO: 1934 - DNA, 24 bp, Homo sapiens
  mature of SEQ ID 163
tgtgagtgggtttggggtgaggct

SEQ ID NO: 1935 - DNA, 20 bp, Homo sapiens
  mature of SEQ ID 164
gtatcttattacatgtttga

SEQ ID NO: 1936 - DNA, 22 bp, Homo sapiens
  mature of SEQ ID 165
atgttgtatagacaattgtgcc

SEQ ID NO: 1937 - DNA, 33 bp, Homo sapiens
  mature of SEQ ID 166
gtcaggtagagtaaaaactttgttaatttgaaa

SEQ ID NO: 1938 - DNA, 31 bp, Homo sapiens
  mature of SEQ ID 166
ctctgaattaattgggtttggattatctgat

SEQ ID NO: 1939 - DNA, 29 bp, Homo sapiens
  mature of SEQ ID 166
tgagctctgaattaattgggtttggatta

SEQ ID NO: 1940 - DNA, 21 bp, Homo sapiens
  mature of SEQ ID 167
aaatataccgtcatatataag

SEQ ID NO: 1941 - DNA, 19 bp, Homo sapiens
  mature of SEQ ID 168
gaagctgagaggcaaaatg

SEQ ID NO: 1942 - DNA, 22 bp, Homo sapiens
  mature of SEQ ID 169
tgtcatggatgaccttggccag

SEQ ID NO: 1943 - DNA, 24 bp, Homo sapiens
  mature of SEQ ID 169
gatggcatggactgtggtcatgag

SEQ ID NO: 1944 - DNA, 34 bp, Homo sapiens
  mature of SEQ ID 170
ccattaaggcaatctggctgccagatgaagtctt

SEQ ID NO: 1945 - DNA, 30 bp, Homo sapiens
  mature of SEQ ID 170
tgtgtgtctggctatgtcaggccagggtgg

SEQ ID NO: 1946 - DNA, 21 bp, Homo sapiens
  mature of SEQ ID 171
ccacgtatgccatctgtctgt

SEQ ID NO: 1947 - DNA, 32 bp, Homo sapiens
  mature of SEQ ID 172
ttattctccctgttttcatcctacttttaagt

SEQ ID NO: 1948 - DNA, 29 bp, Homo sapiens
  mature of SEQ ID 172
tctcttattctccctgttttcatcctact

SEQ ID NO: 1949 - DNA, 29 bp, Homo sapiens
  mature of SEQ ID 175
cggggaccttctggaggtaaatctgcaga

SEQ ID NO: 1950 - DNA, 31 bp, Homo sapiens
  mature of SEQ ID 175
gaccttctggaggtaaatctgcagaatggca

SEQ ID NO: 1951 - DNA, 21 bp, Homo sapiens
  mature of SEQ ID 1323
tgtgaattctcggatcgaccg

SEQ ID NO: 1952 - DNA, 33 bp, Homo sapiens
  mature of SEQ ID 176
tactcaagatgatttaaattgtgaaaatgtcag

SEQ ID NO: 1953 - DNA, 30 bp, Homo sapiens
  mature of SEQ ID 176
tgcaggaaaatcagtaacattagtcatctt

SEQ ID NO: 1954 - DNA, 32 bp, Homo sapiens
  mature of SEQ ID 176
gaaaatcagtaacattagtcatcttaaaaggg

SEQ ID NO: 1955 - DNA, 24 bp, Homo sapiens
  mature of SEQ ID 179
ccaccaaagttaaatagagctatt

SEQ ID NO: 1956 - DNA, 20 bp, Homo sapiens
  mature of SEQ ID 180
aatcaatgggatttttgcaa

SEQ ID NO: 1957 - DNA, 19 bp, Homo sapiens
  mature of SEQ ID 181
attgtactgcaatggctgt

SEQ ID NO: 1958 - DNA, 31 bp, Homo sapiens
  mature of SEQ ID 182
gtggcttgaaaattaactgaattatgaaagc

SEQ ID NO: 1959 - DNA, 33 bp, Homo sapiens
  mature of SEQ ID 183
tgatttgtaacactttaaaaaacattttctagg

SEQ ID NO: 1960 - DNA, 30 bp, Homo sapiens
  mature of SEQ ID 183
ttgattgatttgtaacactttaaaaaacat

SEQ ID NO: 1961 - DNA, 33 bp, Homo sapiens
  mature of SEQ ID 183
gagagtgttttataatgtattcagtttaattaa

SEQ ID NO: 1962 - DNA, 30 bp, Homo sapiens
  mature of SEQ ID 183
attaggagagtgttttataatgtattcagt

SEQ ID NO: 1963 - DNA, 31 bp, Homo sapiens
  mature of SEQ ID 1321
gtgagctttgtggtaatgaagtcagataatg

SEQ ID NO: 1964 - DNA, 29 bp, Homo sapiens
  mature of SEQ ID 1321
ataggtgagctttgtggtaatgaagtcag

SEQ ID NO: 1965 - DNA, 31 bp, Homo sapiens
  mature of SEQ ID 185
acccccagcatgtccactgggctgctgaact

SEQ ID NO: 1966 - DNA, 29 bp, Homo sapiens
  mature of SEQ ID 185
caccacccccagcatgtccactgggctgc

SEQ ID NO: 1967 - DNA, 34 bp, Homo sapiens
  mature of SEQ ID 187
ccctacggtgtgaccccagcctctccctctggcc

SEQ ID NO: 1968 - DNA, 20 bp, Homo sapiens
  mature of SEQ ID 187
ggccggcggggggcctctgg

SEQ ID NO: 1969 - DNA, 34 bp, Homo sapiens
  mature of SEQ ID 188
aaaatgctatctaatgtctcattaagacttgcat

SEQ ID NO: 1970 - DNA, 32 bp, Homo sapiens
  mature of SEQ ID 188
aatcttcaaaatgctatctaatgtctcattaa

SEQ ID NO: 1971 - DNA, 32 bp, Homo sapiens
  mature of SEQ ID 188
atgtatcttaagtacagtcattaaatatagtt

SEQ ID NO: 1972 - DNA, 35 bp, Homo sapiens
  mature of SEQ ID 188
ttaagtacagtcattaaatatagtttagggagatt

SEQ ID NO: 1973 - DNA, 29 bp, Homo sapiens
  mature of SEQ ID 189
gctggacagcaaacatggagagaatcatg

SEQ ID NO: 1974 - DNA, 20 bp, Homo sapiens
  mature of SEQ ID 190
tcatctaagtttaccatgca

SEQ ID NO: 1975 - DNA, 22 bp, Homo sapiens
  mature of SEQ ID 191
gtaattgctggccagctgcagg

SEQ ID NO: 1976 - DNA, 23 bp, Homo sapiens
  mature of SEQ ID 191
gccctgtgagctgtgttcagggc

SEQ ID NO: 1977 - DNA, 31 bp, Homo sapiens
  mature of SEQ ID 192
tgtcacatgactttttggtggcctgattagc

SEQ ID NO: 1978 - DNA, 29 bp, Homo sapiens
  mature of SEQ ID 192
cctttgtcacatgactttttggtggcctg

SEQ ID NO: 1979 - DNA, 25 bp, Homo sapiens
  mature of SEQ ID 192
gttggaaggcacagttaaagggtca

SEQ ID NO: 1980 - DNA, 21 bp, Homo sapiens
  mature of SEQ ID 193
gggcagccaccttgtctccag

SEQ ID NO: 1981 - DNA, 19 bp, Homo sapiens
  mature of SEQ ID 193
ccccacagaggggtggggg

SEQ ID NO: 1982 - DNA, 19 bp, Homo sapiens
  mature of SEQ ID 194
ttttgaaccttacagagta

SEQ ID NO: 1983 - DNA, 28 bp, Homo sapiens
  mature of SEQ ID 194
aataggcaacaagaggaaaattgaatca

SEQ ID NO: 1984 - DNA, 33 bp, Homo sapiens
  mature of SEQ ID 195
agaggtaattgcctgcctttgactcctcttgat

SEQ ID NO: 1985 - DNA, 22 bp, Homo sapiens
  mature of SEQ ID 197
ggaaatatactaagtgtgcatt

SEQ ID NO: 1986 - DNA, 34 bp, Homo sapiens
  mature of SEQ ID 197
tttaaataatggcacttgtgctaagaagtgtatt

SEQ ID NO: 1987 - DNA, 19 bp, Homo sapiens
  mature of SEQ ID 198
tggattagcaagaaaaagc

SEQ ID NO: 1988 - DNA, 31 bp, Homo sapiens
  mature of SEQ ID 199
tgttatcttgaaagctgctacaggctataag

SEQ ID NO: 1989 - DNA, 19 bp, Homo sapiens
  mature of SEQ ID 199
tgtattcatttttaataag

SEQ ID NO: 1990 - DNA, 35 bp, Homo sapiens
  mature of SEQ ID 200
taaaattagacaaagcaataattagtttggcacca

SEQ ID NO: 1991 - DNA, 32 bp, Homo sapiens
  mature of SEQ ID 200
ctggatttaaaattagacaaagcaataattag

SEQ ID NO: 1992 - DNA, 32 bp, Homo sapiens
  mature of SEQ ID 200
gctttgaattaatgtgcaagctgttaatctcc

SEQ ID NO: 1993 - DNA, 29 bp, Homo sapiens
  mature of SEQ ID 200
tggtgctttgaattaatgtgcaagctgtt

SEQ ID NO: 1994 - DNA, 19 bp, Homo sapiens
  mature of SEQ ID 201
ggcagtgatggcatggact

SEQ ID NO: 1995 - DNA, 21 bp, Homo sapiens
  mature of SEQ ID 202
atggagatttctagcccttct

SEQ ID NO: 1996 - DNA, 33 bp, Homo sapiens
  mature of SEQ ID 202
ttagacaaaacataaaggagggttgggagctct

SEQ ID NO: 1997 - DNA, 20 bp, Homo sapiens
  mature of SEQ ID 203
cggagacagtagacactcac

SEQ ID NO: 1998 - DNA, 20 bp, Homo sapiens
  mature of SEQ ID 204
ctgtctcccagcacattgct

SEQ ID NO: 1999 - DNA, 20 bp, Homo sapiens
  mature of SEQ ID 204
gagccccaggaagttgttaa

SEQ ID NO: 2000 - DNA, 22 bp, Homo sapiens
  mature of SEQ ID 205
ttagatcttcatctcttatcac

SEQ ID NO: 2001 - DNA, 31 bp, Homo sapiens
  mature of SEQ ID 205
ataagggaagaagacaagaaaatgatattgt

SEQ ID NO: 2002 - DNA, 29 bp, Homo sapiens
  mature of SEQ ID 205
gtgcataagggaagaagacaagaaaatga

SEQ ID NO: 2003 - DNA, 29 bp, Homo sapiens
  mature of SEQ ID 206
tggggtggcaggtattagggataatattc

SEQ ID NO: 2004 - DNA, 32 bp, Homo sapiens
  mature of SEQ ID 206
gtggcaggtattagggataatattcatttagc

SEQ ID NO: 2005 - DNA, 19 bp, Homo sapiens
  mature of SEQ ID 207
ttattaaagtgggagagag

SEQ ID NO: 2006 - DNA, 26 bp, Homo sapiens
  mature of SEQ ID 208
aattcccttttgagaaatgaattccc

SEQ ID NO: 2007 - DNA, 26 bp, Homo sapiens
  mature of SEQ ID 209
tctactggtaaactgacatatgtata

SEQ ID NO: 2008 - DNA, 20 bp, Homo sapiens
  mature of SEQ ID 210
accagagaatctacatctaa

SEQ ID NO: 2009 - DNA, 28 bp, Homo sapiens
  mature of SEQ ID 211
agttgtacatacataatcacttgattgc

SEQ ID NO: 2010 - DNA, 22 bp, Homo sapiens
  mature of SEQ ID 211
ttgtcacgtattaatttttcat

SEQ ID NO: 2011 - DNA, 34 bp, Homo sapiens
  mature of SEQ ID 212
atgtacatctaattgacactacattgcattaatc

SEQ ID NO: 2012 - DNA, 32 bp, Homo sapiens
  mature of SEQ ID 212
ttcaggaatgtacatctaattgacactacatt

SEQ ID NO: 2013 - DNA, 19 bp, Homo sapiens
  mature of SEQ ID 213
ttaacgctgagggggaggc

SEQ ID NO: 2014 - DNA, 30 bp, Homo sapiens
  mature of SEQ ID 214
aacctatcaatcaaacccatgttattcctt

SEQ ID NO: 2015 - DNA, 33 bp, Homo sapiens
  mature of SEQ ID 214
atcaatcaaacccatgttattcctttgggagct

SEQ ID NO: 2016 - DNA, 32 bp, Homo sapiens
  mature of SEQ ID 214
cagaatgaggaataaaggggtttacatatgtt

SEQ ID NO: 2017 - DNA, 27 bp, Homo sapiens
  mature of SEQ ID 215
agtgtgtttgaatttcacaagtataat

SEQ ID NO: 2018 - DNA, 34 bp, Homo sapiens
  mature of SEQ ID 217
gcaggaagtgctgatagcattctatataaataag

SEQ ID NO: 2019 - DNA, 30 bp, Homo sapiens
  mature of SEQ ID 218
ggagtcttcatcactgatgccagccatcag

SEQ ID NO: 2020 - DNA, 33 bp, Homo sapiens
  mature of SEQ ID 220
aaagatataaatgctaaatactgtttaacttta

SEQ ID NO: 2021 - DNA, 31 bp, Homo sapiens
  mature of SEQ ID 220
cactggaaagatataaatgctaaatactgtt

SEQ ID NO: 2022 - DNA, 28 bp, Homo sapiens
  mature of SEQ ID 221
ggagagggatgaaggagatcctttgtga

SEQ ID NO: 2023 - DNA, 24 bp, Homo sapiens
  mature of SEQ ID 222
agggaattttaaaacttgacaaac

SEQ ID NO: 2024 - DNA, 24 bp, Homo sapiens
  mature of SEQ ID 222
tttttaaacaatgaatgttgtttt

SEQ ID NO: 2025 - DNA, 32 bp, Homo sapiens
  mature of SEQ ID 223
ctttaagcctcattagatttcttgatagcaaa

SEQ ID NO: 2026 - DNA, 34 bp, Homo sapiens
  mature of SEQ ID 223
cctcattagatttcttgatagcaaaacctcccat

SEQ ID NO: 2027 - DNA, 33 bp, Homo sapiens
  mature of SEQ ID 224
gtctgtcacccttgattggaaagtaataattca

SEQ ID NO: 2028 - DNA, 19 bp, Homo sapiens
  mature of SEQ ID 224
tctgcctggagtgatagat

SEQ ID NO: 2029 - DNA, 22 bp, Homo sapiens
  mature of SEQ ID 225
gatgcttagaaaatccttgagc

SEQ ID NO: 2030 - DNA, 19 bp, Homo sapiens
  mature of SEQ ID 295
tgtagtccacatcgctgac

SEQ ID NO: 2031 - DNA, 28 bp, Homo sapiens
  mature of SEQ ID 227
cccagcatgtccactgggctgctgaact

SEQ ID NO: 2032 - DNA, 19 bp, Homo sapiens
  mature of SEQ ID 228
agtgttttattgcctagtt

SEQ ID NO: 2033 - DNA, 29 bp, Homo sapiens
  mature of SEQ ID 229
ccctccccctgctgggatccccccagccc

SEQ ID NO: 2034 - DNA, 34 bp, Homo sapiens
  mature of SEQ ID 230
tggaatgaaaaatctgattaaaatctaaattggc

SEQ ID NO: 2035 - DNA, 34 bp, Homo sapiens
  mature of SEQ ID 230
ttactaatagtcatttttctaagtcaaatgcttt

SEQ ID NO: 2036 - DNA, 32 bp, Homo sapiens
  mature of SEQ ID 230
gtcagttttactaatagtcatttttctaagtc

SEQ ID NO: 2037 - DNA, 28 bp, Homo sapiens
  mature of SEQ ID 231
ttcagatgtgttttggattgaaaatagg

SEQ ID NO: 2038 - DNA, 29 bp, Homo sapiens
  mature of SEQ ID 231
ctctccgttacatctgatttgcggttccc

SEQ ID NO: 2039 - DNA, 20 bp, Homo sapiens
  mature of SEQ ID 232
agagtaaattccagggggtc

SEQ ID NO: 2040 - DNA, 19 bp, Homo sapiens
  mature of SEQ ID 233
gtgcataaaattctttatt

SEQ ID NO: 2041 - DNA, 26 bp, Homo sapiens
  mature of SEQ ID 234
gcgaaggtgtccaaactgacaatgct

SEQ ID NO: 2042 - DNA, 32 bp, Homo sapiens
  mature of SEQ ID 234
gcgaggggtgtcagattgagtgctctgtgcgc

SEQ ID NO: 2043 - DNA, 30 bp, Homo sapiens
  mature of SEQ ID 234
ccccggcgaggggtgtcagattgagtgctc

SEQ ID NO: 2044 - DNA, 19 bp, Homo sapiens
  mature of SEQ ID 235
ggctcgctcgggaagctga

SEQ ID NO: 2045 - DNA, 21 bp, Homo sapiens
  mature of SEQ ID 235
gctcctgctccgccgcgggag

SEQ ID NO: 2046 - DNA, 30 bp, Homo sapiens
  mature of SEQ ID 236
attctgaatggagctttaatcagcttagcc

SEQ ID NO: 2047 - DNA, 26 bp, Homo sapiens
  mature of SEQ ID 237
tttgttccttgtatacaattattgta

SEQ ID NO: 2048 - DNA, 31 bp, Homo sapiens
  mature of SEQ ID 237
actaattaatctgctggagctgatgaaatgt

SEQ ID NO: 2049 - DNA, 29 bp, Homo sapiens
  mature of SEQ ID 237
tacaactaattaatctgctggagctgatg

SEQ ID NO: 2050 - DNA, 22 bp, Homo sapiens
  mature of SEQ ID 238
ttcaataactctgaccattgtg

SEQ ID NO: 2051 - DNA, 27 bp, Homo sapiens
  mature of SEQ ID 238
agcgattttccataattttgttcagaa

SEQ ID NO: 2052 - DNA, 22 bp, Homo sapiens
  mature of SEQ ID 239
ttcttgcagggaacaatattgc

SEQ ID NO: 2053 - DNA, 21 bp, Homo sapiens
  mature of SEQ ID 240
gtccaccgcaaatgcttctag

SEQ ID NO: 2054 - DNA, 35 bp, Homo sapiens
  mature of SEQ ID 240
ttccagcagatgtggatcagcaagcaggagtatga

SEQ ID NO: 2055 - DNA, 32 bp, Homo sapiens
  mature of SEQ ID 240
gtccaccttccagcagatgtggatcagcaagc

SEQ ID NO: 2056 - DNA, 26 bp, Homo sapiens
  mature of SEQ ID 241
tgttgtcatggtgcagctaacagggt

SEQ ID NO: 2057 - DNA, 34 bp, Homo sapiens
  mature of SEQ ID 241
tttcatgcttcatcaacaattaagttaattagct

SEQ ID NO: 2058 - DNA, 31 bp, Homo sapiens
  mature of SEQ ID 241
gaactgtttcatgcttcatcaacaattaagt

SEQ ID NO: 2059 - DNA, 27 bp, Homo sapiens
  mature of SEQ ID 242
ttttgtataggtatttcataacaaaaa

SEQ ID NO: 2060 - DNA, 34 bp, Homo sapiens
  mature of SEQ ID 243
gttgtcaagcctaacaagcaggtcatgcaatttg

SEQ ID NO: 2061 - DNA, 24 bp, Homo sapiens
  mature of SEQ ID 244
ctggattttccaggacattcacat

SEQ ID NO: 2062 - DNA, 20 bp, Homo sapiens
  mature of SEQ ID 245
gtttaaaaacctcacagctt

SEQ ID NO: 2063 - DNA, 29 bp, Homo sapiens
  mature of SEQ ID 245
aagcttaagtgaggatttccttgcaatga

SEQ ID NO: 2064 - DNA, 31 bp, Homo sapiens
  mature of SEQ ID 245
ttaagtgaggatttccttgcaatgagtagaa

SEQ ID NO: 2065 - DNA, 32 bp, Homo sapiens
  mature of SEQ ID 246
gtctctggcttctgtttcttatgctgctgttg

SEQ ID NO: 2066 - DNA, 23 bp, Homo sapiens
  mature of SEQ ID 247
catttgataaggatgctgagtgc

SEQ ID NO: 2067 - DNA, 20 bp, Homo sapiens
  mature of SEQ ID 247
gcagctgaagttgaaaagaa

SEQ ID NO: 2068 - DNA, 33 bp, Homo sapiens
  mature of SEQ ID 248
cgtgaggaggagggacttttcgaagttttatag

SEQ ID NO: 2069 - DNA, 20 bp, Homo sapiens
  mature of SEQ ID 249
gcggtgactgacaagccttt

SEQ ID NO: 2070 - DNA, 32 bp, Homo sapiens
  mature of SEQ ID 249
gggactaatggtttaaacttgttagtcattgt

SEQ ID NO: 2071 - DNA, 24 bp, Homo sapiens
  mature of SEQ ID 250
tccaagcatgaactaatgttgggg

SEQ ID NO: 2072 - DNA, 22 bp, Homo sapiens
  mature of SEQ ID 251
agcacccggagctggcagacaa

SEQ ID NO: 2073 - DNA, 24 bp, Homo sapiens
  mature of SEQ ID 252
aagggctgcactgttttacaaggc

SEQ ID NO: 2074 - DNA, 19 bp, Homo sapiens
  mature of SEQ ID 252
gcctataaaacagtgtcct

SEQ ID NO: 2075 - DNA, 20 bp, Homo sapiens
  mature of SEQ ID 253
gagtttcaaggtgtggcccc

SEQ ID NO: 2076 - DNA, 22 bp, Homo sapiens
  mature of SEQ ID 254
cgagaagtcgatcacctcgtcc

SEQ ID NO: 2077 - DNA, 24 bp, Homo sapiens
  mature of SEQ ID 255
gagtttcaattctaaatgctttta

SEQ ID NO: 2078 - DNA, 21 bp, Homo sapiens
  mature of SEQ ID 256
aggggggctttctctctcgcc

SEQ ID NO: 2079 - DNA, 23 bp, Homo sapiens
  mature of SEQ ID 257
cttctaaagagcagtcatcaaca

SEQ ID NO: 2080 - DNA, 20 bp, Homo sapiens
  mature of SEQ ID 258
aaactgctgtatgcaaacat

SEQ ID NO: 2081 - DNA, 25 bp, Homo sapiens
  mature of SEQ ID 258
tgtatgtatgtctgtaggggttggg

SEQ ID NO: 2082 - DNA, 32 bp, Homo sapiens
  mature of SEQ ID 259
agataaattacagtacatgccagggaacaggc

SEQ ID NO: 2083 - DNA, 29 bp, Homo sapiens
  mature of SEQ ID 259
gactagataaattacagtacatgccaggg

SEQ ID NO: 2084 - DNA, 31 bp, Homo sapiens
  mature of SEQ ID 259
gcccatttccctaatggcagccgattgccat

SEQ ID NO: 2085 - DNA, 34 bp, Homo sapiens
  mature of SEQ ID 259
ttccctaatggcagccgattgccatttgctattc

SEQ ID NO: 2086 - DNA, 24 bp, Homo sapiens
  mature of SEQ ID 261
ggcccctcccccaccattgttctg

SEQ ID NO: 2087 - DNA, 25 bp, Homo sapiens
  mature of SEQ ID 261
cccatggtggggcccctaggcagtg

SEQ ID NO: 2088 - DNA, 22 bp, Homo sapiens
  mature of SEQ ID 262
cagagcttcattgagttatcaa

SEQ ID NO: 2089 - DNA, 22 bp, Homo sapiens
  mature of SEQ ID 262
gacaatggaggcttgaaagtaa

SEQ ID NO: 2090 - DNA, 29 bp, Homo sapiens
  mature of SEQ ID 263
cttatttatatgtagatgtagctatatga

SEQ ID NO: 2091 - DNA, 24 bp, Homo sapiens
  mature of SEQ ID 263
acatttgcatatgaaggtctcttt

SEQ ID NO: 2092 - DNA, 27 bp, Homo sapiens
  mature of SEQ ID 264
tagtggcaagcagatcatgttaactgg

SEQ ID NO: 2093 - DNA, 20 bp, Homo sapiens
  mature of SEQ ID 264
gttgcaaaagtgaaaaatat

SEQ ID NO: 2094 - DNA, 19 bp, Homo sapiens
  mature of SEQ ID 265
aaaacatccacaaagcctg

SEQ ID NO: 2095 - DNA, 29 bp, Homo sapiens
  mature of SEQ ID 266
ctgtgataatgtaatggtttgcaaaataa

SEQ ID NO: 2096 - DNA, 25 bp, Homo sapiens
  mature of SEQ ID 267
ctggggctgggatggaattcagcta

SEQ ID NO: 2097 - DNA, 19 bp, Homo sapiens
  mature of SEQ ID 267
ggttttattcttgtgttag

SEQ ID NO: 2098 - DNA, 20 bp, Homo sapiens
  mature of SEQ ID 268
tacatcctggcctagcagtc

SEQ ID NO: 2099 - DNA, 20 bp, Homo sapiens
  mature of SEQ ID 269
ttctggagtggtgccaggcc

SEQ ID NO: 2100 - DNA, 19 bp, Homo sapiens
  mature of SEQ ID 271
ccaactttcccaaagtaac

SEQ ID NO: 2101 - DNA, 26 bp, Homo sapiens
  mature of SEQ ID 271
gtgatatttgtcaaagttgatcctgt

SEQ ID NO: 2102 - DNA, 25 bp, Homo sapiens
  mature of SEQ ID 272
tgatcaggaaaggagagacacagat

SEQ ID NO: 2103 - DNA, 20 bp, Homo sapiens
  mature of SEQ ID 273
aagaagaaattgggatttag

SEQ ID NO: 2104 - DNA, 33 bp, Homo sapiens
  mature of SEQ ID 273
aatggaatcaatggtactttaatatgtgttaat

SEQ ID NO: 2105 - DNA, 30 bp, Homo sapiens
  mature of SEQ ID 273
gcactaatggaatcaatggtactttaatat

SEQ ID NO: 2106 - DNA, 22 bp, Homo sapiens
  mature of SEQ ID 274
tttgtattcatgtcaatgattc

SEQ ID NO: 2107 - DNA, 24 bp, Homo sapiens
  mature of SEQ ID 274
taatcttattgagaggaatcaaaa

SEQ ID NO: 2108 - DNA, 27 bp, Homo sapiens
  mature of SEQ ID 275
caaaattggcattttagctaatactgt

SEQ ID NO: 2109 - DNA, 29 bp, Homo sapiens
  mature of SEQ ID 275
aattttaattagtatttttggctttaatg

SEQ ID NO: 2110 - DNA, 32 bp, Homo sapiens
  mature of SEQ ID 275
ttaattagtatttttggctttaatgaaaagtg

SEQ ID NO: 2111 - DNA, 34 bp, Homo sapiens
  mature of SEQ ID 276
gcagtgtgattgctgctttagtggcaccagggag

SEQ ID NO: 2112 - DNA, 26 bp, Homo sapiens
  mature of SEQ ID 276
gcatctcttgccaatcaaatcagtgc

SEQ ID NO: 2113 - DNA, 25 bp, Homo sapiens
  mature of SEQ ID 277
cggaatcaggtgctgaaccgagccc

SEQ ID NO: 2114 - DNA, 27 bp, Homo sapiens
  mature of SEQ ID 277
gggcttgggtccggctcccccgccgcc

SEQ ID NO: 2115 - DNA, 33 bp, Homo sapiens
  mature of SEQ ID 278
cacatttgatttgctttttcctttgtttatgct

SEQ ID NO: 2116 - DNA, 33 bp, Homo sapiens
  mature of SEQ ID 279
tgggtaaaaataaacattggccttcagccacac

SEQ ID NO: 2117 - DNA, 30 bp, Homo sapiens
  mature of SEQ ID 279
cctggaggcccagtggcccacaatcccatt

SEQ ID NO: 2118 - DNA, 19 bp, Homo sapiens
  mature of SEQ ID 280
caagcttgtttctcctggg

SEQ ID NO: 2119 - DNA, 31 bp, Homo sapiens
  mature of SEQ ID 281
gggtgctggtggacatggacggcgtgctggc

SEQ ID NO: 2120 - DNA, 22 bp, Homo sapiens
  mature of SEQ ID 282
agtgattcccagggcccagcaa

SEQ ID NO: 2121 - DNA, 22 bp, Homo sapiens
  mature of SEQ ID 283
aggaacaatggctgtttaattt

SEQ ID NO: 2122 - DNA, 20 bp, Homo sapiens
  mature of SEQ ID 284
ctcactttaatatacatgag

SEQ ID NO: 2123 - DNA, 21 bp, Homo sapiens
  mature of SEQ ID 284
attgcattatgcaagtcagca

SEQ ID NO: 2124 - DNA, 28 bp, Homo sapiens
  mature of SEQ ID 286
gtgttagcaaagtttctttgaggtcttt

SEQ ID NO: 2125 - DNA, 21 bp, Homo sapiens
  mature of SEQ ID 288
tctttacagattatcaataca

SEQ ID NO: 2126 - DNA, 22 bp, Homo sapiens
  mature of SEQ ID 288
tggttgtgttttgagaaattgt

SEQ ID NO: 2127 - DNA, 24 bp, Homo sapiens
  mature of SEQ ID 289
aggcccatatcctgacattgatcc

SEQ ID NO: 2128 - DNA, 28 bp, Homo sapiens
  mature of SEQ ID 289
atagaaatcaatgacaggatatggacct

SEQ ID NO: 2129 - DNA, 26 bp, Homo sapiens
  mature of SEQ ID 290
caaagcctccgctggggctgtttctt

SEQ ID NO: 2130 - DNA, 33 bp, Homo sapiens
  mature of SEQ ID 290
acagctccagacggaaatccacgccaggctttg

SEQ ID NO: 2131 - DNA, 27 bp, Homo sapiens
  mature of SEQ ID 291
atgtgcctaagctctgttcattaatct

SEQ ID NO: 2132 - DNA, 21 bp, Homo sapiens
  mature of SEQ ID 291
aggttaacagcagtggcacat

SEQ ID NO: 2133 - DNA, 29 bp, Homo sapiens
  mature of SEQ ID 292
ggcagtggactccagcagggctgcagtga

SEQ ID NO: 2134 - DNA, 31 bp, Homo sapiens
  mature of SEQ ID 292
gtggactccagcagggctgcagtgagtttgg

SEQ ID NO: 2135 - DNA, 31 bp, Homo sapiens
  mature of SEQ ID 293
tgaaacagatggaagtatttgttatacaaac

SEQ ID NO: 2136 - DNA, 34 bp, Homo sapiens
  mature of SEQ ID 293
agatggaagtatttgttatacaaaccttatttag

SEQ ID NO: 2137 - DNA, 21 bp, Homo sapiens
  mature of SEQ ID 294
cactttgataaaagccattta

SEQ ID NO: 2138 - DNA, 34 bp, Homo sapiens
  mature of SEQ ID 295
accacccccagcatgtccactgggctgctgaact

SEQ ID NO: 2139 - DNA, 32 bp, Homo sapiens
  mature of SEQ ID 295
ggccagcaccacccccagcatgtccactgggc

SEQ ID NO: 2140 - DNA, 19 bp, Homo sapiens
  mature of SEQ ID 296
gcacagtaatgaccttgcc

SEQ ID NO: 2141 - DNA, 19 bp, Homo sapiens
  mature of SEQ ID 296
atttatgtgattactgtgt

SEQ ID NO: 2142 - DNA, 29 bp, Homo sapiens
  mature of SEQ ID 298
tgtcattcattttaaggactttttattgt

SEQ ID NO: 2143 - DNA, 22 bp, Homo sapiens
  mature of SEQ ID 299
tgccccatttatattcctaagt

SEQ ID NO: 2144 - DNA, 31 bp, Homo sapiens
  mature of SEQ ID 299
acttgttaatatggagcctgcctctggggaa

SEQ ID NO: 2145 - DNA, 30 bp, Homo sapiens
  mature of SEQ ID 300
gtcatagatggcctcattgtctaccatgaa

SEQ ID NO: 2146 - DNA, 19 bp, Homo sapiens
  mature of SEQ ID 301
tgtaatcatatctaattag

SEQ ID NO: 2147 - DNA, 20 bp, Homo sapiens
  mature of SEQ ID 302
ggattctccaaatactccat

SEQ ID NO: 2148 - DNA, 19 bp, Homo sapiens
  mature of SEQ ID 303
aacaggatgacagacggcc

SEQ ID NO: 2149 - DNA, 22 bp, Homo sapiens
  mature of SEQ ID 303
ttgctgcctcccaccttcctct

SEQ ID NO: 2150 - DNA, 33 bp, Homo sapiens
  mature of SEQ ID 304
ccaacccaaatgattatatgattaagataccag

SEQ ID NO: 2151 - DNA, 30 bp, Homo sapiens
  mature of SEQ ID 304
tccttccaacccaaatgattatatgattaa

SEQ ID NO: 2152 - DNA, 30 bp, Homo sapiens
  mature of SEQ ID 305
ggggaatatgttatttaacttaggccgaag

SEQ ID NO: 2153 - DNA, 33 bp, Homo sapiens
  mature of SEQ ID 305
atatgttatttaacttaggccgaagactgtact

SEQ ID NO: 2154 - DNA, 19 bp, Homo sapiens
  mature of SEQ ID 306
aagtacagtcaagagatac

SEQ ID NO: 2155 - DNA, 19 bp, Homo sapiens
  mature of SEQ ID 307
tcacaagagagaacctcag

SEQ ID NO: 2156 - DNA, 23 bp, Homo sapiens
  mature of SEQ ID 307
aaatgattctgaggttcctgggt

SEQ ID NO: 2157 - DNA, 29 bp, Homo sapiens
  mature of SEQ ID 310
agaacatgtgctcattactgggtcttaga

SEQ ID NO: 2158 - DNA, 32 bp, Homo sapiens
  mature of SEQ ID 310
catgtgctcattactgggtcttagaggctaaa

SEQ ID NO: 2159 - DNA, 22 bp, Homo sapiens
  mature of SEQ ID 311
attcattgtcataccaggaaat

SEQ ID NO: 2160 - DNA, 32 bp, Homo sapiens
  mature of SEQ ID 312
ttaagatgtgacagcttgattattttacaagg

SEQ ID NO: 2161 - DNA, 30 bp, Homo sapiens
  mature of SEQ ID 312
gatttttaagatgtgacagcttgattattt

SEQ ID NO: 2162 - DNA, 20 bp, Homo sapiens
  mature of SEQ ID 313
accagatatatgttctctag

SEQ ID NO: 2163 - DNA, 23 bp, Homo sapiens
  mature of SEQ ID 315
agttcctgaatgttcttggtgac

SEQ ID NO: 2164 - DNA, 34 bp, Homo sapiens
  mature of SEQ ID 316
gtgaaatctatcaaggaaggagggttatttttac

SEQ ID NO: 2165 - DNA, 31 bp, Homo sapiens
  mature of SEQ ID 316
atttcaacctatttttaagggttattttcac

SEQ ID NO: 2166 - DNA, 29 bp, Homo sapiens
  mature of SEQ ID 316
gtaaatttcaacctatttttaagggttat

SEQ ID NO: 2167 - DNA, 27 bp, Homo sapiens
  mature of SEQ ID 317
ttcagtttatgagctgttaagcctgtt

SEQ ID NO: 2168 - DNA, 34 bp, Homo sapiens
  mature of SEQ ID 318
tgtttctgtcagtcattttggaacatatgattca

SEQ ID NO: 2169 - DNA, 19 bp, Homo sapiens
  mature of SEQ ID 319
tggctgtgcagtggagcac

SEQ ID NO: 2170 - DNA, 27 bp, Homo sapiens
  mature of SEQ ID 319
gacaagttcagagagtttgtcagttcc

SEQ ID NO: 2171 - DNA, 25 bp, Homo sapiens
  mature of SEQ ID 320
tgaaaatacttccctcccacacaaa

SEQ ID NO: 2172 - DNA, 22 bp, Homo sapiens
  mature of SEQ ID 322
tcttcagctgtgtgtttatctg

SEQ ID NO: 2173 - DNA, 33 bp, Homo sapiens
  mature of SEQ ID 323
attttaattttatcccagttatggatatctggc

SEQ ID NO: 2174 - DNA, 31 bp, Homo sapiens
  mature of SEQ ID 323
gcacagattttaattttatcccagttatgga

SEQ ID NO: 2175 - DNA, 26 bp, Homo sapiens
  mature of SEQ ID 323
tactctgggcagactggtgtgaaatt

SEQ ID NO: 2176 - DNA, 19 bp, Homo sapiens
  mature of SEQ ID 324
aaaatggattgccaggaaa

SEQ ID NO: 2177 - DNA, 23 bp, Homo sapiens
  mature of SEQ ID 325
gtttatagagagtaaactgtttt

SEQ ID NO: 2178 - DNA, 25 bp, Homo sapiens
  mature of SEQ ID 326
cattttttcaaatgcaaattacctt

SEQ ID NO: 2179 - DNA, 24 bp, Homo sapiens
  mature of SEQ ID 327
ggaaccaaaattgcatctgatggc

SEQ ID NO: 2180 - DNA, 31 bp, Homo sapiens
  mature of SEQ ID 328
ggtgcgcagggaggtcggaggagcgggcact

SEQ ID NO: 2181 - DNA, 33 bp, Homo sapiens
  mature of SEQ ID 328
cagggaggtcggaggagcgggcactgcccaccc

SEQ ID NO: 2182 - DNA, 21 bp, Homo sapiens
  mature of SEQ ID 329
agccgcggccccataaatcgt

SEQ ID NO: 2183 - DNA, 29 bp, Homo sapiens
  mature of SEQ ID 331
accatggtgacttgggctgtatttggcga

SEQ ID NO: 2184 - DNA, 29 bp, Homo sapiens
  mature of SEQ ID 331
ctgtaaatgctcagtagctgttaatatga

SEQ ID NO: 2185 - DNA, 19 bp, Homo sapiens
  mature of SEQ ID 332
aacatgcgtgctgaggtgc

SEQ ID NO: 2186 - DNA, 19 bp, Homo sapiens
  mature of SEQ ID 333
agactggttaatgataaca

SEQ ID NO: 2187 - DNA, 32 bp, Homo sapiens
  mature of SEQ ID 334
cttgacaagttgtggtggagcacctgcatttg

SEQ ID NO: 2188 - DNA, 29 bp, Homo sapiens
  mature of SEQ ID 334
ctgtcttgacaagttgtggtggagcacct

SEQ ID NO: 2189 - DNA, 27 bp, Homo sapiens
  mature of SEQ ID 335
ggattttaatcacaaatttgcagctcc

SEQ ID NO: 2190 - DNA, 23 bp, Homo sapiens
  mature of SEQ ID 337
ctgcttccaggctgtatttttag

SEQ ID NO: 2191 - DNA, 23 bp, Homo sapiens
  mature of SEQ ID 337
ggggacaaggggctggaaaatgc

SEQ ID NO: 2192 - DNA, 32 bp, Homo sapiens
  mature of SEQ ID 338
gagtgtgtaattagccacatatgcattgttct

SEQ ID NO: 2193 - DNA, 20 bp, Homo sapiens
  mature of SEQ ID 339
ttaggtttcatcaaacaaag

SEQ ID NO: 2194 - DNA, 32 bp, Homo sapiens
  mature of SEQ ID 339
ttatctatggattttctccttagatgtttaaa

SEQ ID NO: 2195 - DNA, 35 bp, Homo sapiens
  mature of SEQ ID 339
tggattttctccttagatgtttaaatattccccct

SEQ ID NO: 2196 - DNA, 19 bp, Homo sapiens
  mature of SEQ ID 340
gcatgcttggaaataggag

SEQ ID NO: 2197 - DNA, 19 bp, Homo sapiens
  mature of SEQ ID 340
gggtggcagttattgctgg

SEQ ID NO: 2198 - DNA, 21 bp, Homo sapiens
  mature of SEQ ID 341
ccggtgcgcggccgcggcgag

SEQ ID NO: 2199 - DNA, 29 bp, Homo sapiens
  mature of SEQ ID 341
tgtttcctctccggcccccaccgcggatc

SEQ ID NO: 2200 - DNA, 32 bp, Homo sapiens
  mature of SEQ ID 341
tcctctccggcccccaccgcggatcatgtacc

SEQ ID NO: 2201 - DNA, 31 bp, Homo sapiens
  mature of SEQ ID 344
aaaaggtatgattgctcaggaatgaaaacat

SEQ ID NO: 2202 - DNA, 29 bp, Homo sapiens
  mature of SEQ ID 344
agataaaaggtatgattgctcaggaatga

SEQ ID NO: 2203 - DNA, 20 bp, Homo sapiens
  mature of SEQ ID 344
gtatgttttcatgtttatct

SEQ ID NO: 2204 - DNA, 27 bp, Homo sapiens
  mature of SEQ ID 348
aatgttatctcagtcagtctctcatta

SEQ ID NO: 2205 - DNA, 32 bp, Homo sapiens
  mature of SEQ ID 348
agactgctgaaaataattaacattccttttga

SEQ ID NO: 2206 - DNA, 30 bp, Homo sapiens
  mature of SEQ ID 348
taattagactgctgaaaataattaacattc

SEQ ID NO: 2207 - DNA, 20 bp, Homo sapiens
  mature of SEQ ID 349
cataagcttgggaaaatgtt

SEQ ID NO: 2208 - DNA, 21 bp, Homo sapiens
  mature of SEQ ID 349
cagagattcccagagttctca

SEQ ID NO: 2209 - DNA, 35 bp, Homo sapiens
  mature of SEQ ID 350
agtaaattaaatatgtataacttgtgaagatttca

SEQ ID NO: 2210 - DNA, 32 bp, Homo sapiens
  mature of SEQ ID 350
ttgaatcagtaaattaaatatgtataacttgt

SEQ ID NO: 2211 - DNA, 28 bp, Homo sapiens
  mature of SEQ ID 351
ctattctgttagcaaatttattttcttc

SEQ ID NO: 2212 - DNA, 32 bp, Homo sapiens
  mature of SEQ ID 351
gacggatgataaaaatgtcacggtgtgatgct

SEQ ID NO: 2213 - DNA, 34 bp, Homo sapiens
  mature of SEQ ID 351
gataaaaatgtcacggtgtgatgctttagcaggc

SEQ ID NO: 2214 - DNA, 28 bp, Homo sapiens
  mature of SEQ ID 352
cagaaaagatgatggagaccatggacca

SEQ ID NO: 2215 - DNA, 21 bp, Homo sapiens
  mature of SEQ ID 353
gctttgtctctggtctgtact

SEQ ID NO: 2216 - DNA, 33 bp, Homo sapiens
  mature of SEQ ID 354
tattcagcaataagaccataatttttcatattt

SEQ ID NO: 2217 - DNA, 23 bp, Homo sapiens
  mature of SEQ ID 356
tcacagagttatattggttgaga

SEQ ID NO: 2218 - DNA, 30 bp, Homo sapiens
  mature of SEQ ID 356
gccagattctcaacttacgtaattctatgg

SEQ ID NO: 2219 - DNA, 34 bp, Homo sapiens
  mature of SEQ ID 357
acttgttaatttatttctctgtttgttaatgggc

SEQ ID NO: 2220 - DNA, 30 bp, Homo sapiens
  mature of SEQ ID 357
gctctattatacagaacagaaggaacattt

SEQ ID NO: 2221 - DNA, 32 bp, Homo sapiens
  mature of SEQ ID 357
attatacagaacagaaggaacatttggtgggt

SEQ ID NO: 2222 - DNA, 20 bp, Homo sapiens
  mature of SEQ ID 358
tatatgattgcgagtggaaa

SEQ ID NO: 2223 - DNA, 28 bp, Homo sapiens
  mature of SEQ ID 359
cacaatagtttaaataaagtggtggttt

SEQ ID NO: 2224 - DNA, 29 bp, Homo sapiens
  mature of SEQ ID 359
attttacccatttctttaaacaaattgcc

SEQ ID NO: 2225 - DNA, 32 bp, Homo sapiens
  mature of SEQ ID 359
tacccatttctttaaacaaattgccaatcctt

SEQ ID NO: 2226 - DNA, 25 bp, Homo sapiens
  mature of SEQ ID 360
gctgcattttgattttgcattcaat

SEQ ID NO: 2227 - DNA, 26 bp, Homo sapiens
  mature of SEQ ID 361
atttgtttactgtagctggaggtgcc

SEQ ID NO: 2228 - DNA, 21 bp, Homo sapiens
  mature of SEQ ID 363
acagggaactttttgatgagc

SEQ ID NO: 2229 - DNA, 33 bp, Homo sapiens
  mature of SEQ ID 363
ggggttcatcggagaaactccctgcgatgagcc

SEQ ID NO: 2230 - DNA, 31 bp, Homo sapiens
  mature of SEQ ID 364
ctggtttgttgaagcagtaagtcagacaaca

SEQ ID NO: 2231 - DNA, 31 bp, Homo sapiens
  mature of SEQ ID 366
gtacttggtttttctaatttgacagaggata

SEQ ID NO: 2232 - DNA, 34 bp, Homo sapiens
  mature of SEQ ID 366
ggtttttctaatttgacagaggataaaagaaggc

SEQ ID NO: 2233 - DNA, 32 bp, Homo sapiens
  mature of SEQ ID 366
tgttttatttctaaactcatttagcaccaagt

SEQ ID NO: 2234 - DNA, 30 bp, Homo sapiens
  mature of SEQ ID 366
ggctttgttttatttctaaactcatttagc

SEQ ID NO: 2235 - DNA, 25 bp, Homo sapiens
  mature of SEQ ID 367
attgaaactgtatagatgattgata

SEQ ID NO: 2236 - DNA, 25 bp, Homo sapiens
  mature of SEQ ID 367
tatcaaattctctataaatctttca

SEQ ID NO: 2237 - DNA, 28 bp, Homo sapiens
  mature of SEQ ID 368
gcgggtaaacggcgggagtaactatgac

SEQ ID NO: 2238 - DNA, 34 bp, Homo sapiens
  mature of SEQ ID 368
gatgtgatttctgcccagtgctctgaatgtcaaa

SEQ ID NO: 2239 - DNA, 19 bp, Homo sapiens
  mature of SEQ ID 369
tttcagctccaaagctgca

SEQ ID NO: 2240 - DNA, 34 bp, Homo sapiens
  mature of SEQ ID 370
gcttaattacaatgtgatgcctaatatattgtga

SEQ ID NO: 2241 - DNA, 27 bp, Homo sapiens
  mature of SEQ ID 370
tctcaaagtatttacatatttgtagtt

SEQ ID NO: 2242 - DNA, 20 bp, Homo sapiens
  mature of SEQ ID 372
ccagccaatgatgaacaagc

SEQ ID NO: 2243 - DNA, 19 bp, Homo sapiens
  mature of SEQ ID 373
tttgattttctgccatact

SEQ ID NO: 2244 - DNA, 31 bp, Homo sapiens
  mature of SEQ ID 373
aagagggtcaagggaatttattcctgtgctt

SEQ ID NO: 2245 - DNA, 33 bp, Homo sapiens
  mature of SEQ ID 374
tttttcaataaacttttcttgtgtgacaggtgg

SEQ ID NO: 2246 - DNA, 28 bp, Homo sapiens
  mature of SEQ ID 375
tgaacaagaagggtttcctgtttaagct

SEQ ID NO: 2247 - DNA, 30 bp, Homo sapiens
  mature of SEQ ID 376
tgtgtctcttaatgatgctcatttaaatac

SEQ ID NO: 2248 - DNA, 32 bp, Homo sapiens
  mature of SEQ ID 376
ctcttaatgatgctcatttaaatactgtcaac

SEQ ID NO: 2249 - DNA, 20 bp, Homo sapiens
  mature of SEQ ID 376
gtttaatattcatgattttg

SEQ ID NO: 2250 - DNA, 20 bp, Homo sapiens
  mature of SEQ ID 377
caacccgggcagggcccttt

SEQ ID NO: 2251 - DNA, 23 bp, Homo sapiens
  mature of SEQ ID 377
ctcaggatgaaatgggccgcagg

SEQ ID NO: 2252 - DNA, 25 bp, Homo sapiens
  mature of SEQ ID 378
aatcaaaggtatgtttcatgccagc

SEQ ID NO: 2253 - DNA, 21 bp, Homo sapiens
  mature of SEQ ID 379
acagtattaatttatagcagg

SEQ ID NO: 2254 - DNA, 25 bp, Homo sapiens
  mature of SEQ ID 380
gggtcaattgtgcagatgtctttaa

SEQ ID NO: 2255 - DNA, 20 bp, Homo sapiens
  mature of SEQ ID 381
aaattatgctaagtagcttc

SEQ ID NO: 2256 - DNA, 20 bp, Homo sapiens
  mature of SEQ ID 596
ttattttttatatacatgta

SEQ ID NO: 2257 - DNA, 34 bp, Homo sapiens
  mature of SEQ ID 383
ttgctttgcaaattaaagtgttactatgagattg

SEQ ID NO: 2258 - DNA, 28 bp, Homo sapiens
  mature of SEQ ID 383
tagtaactatcatgtaattgcagggtaa

SEQ ID NO: 2259 - DNA, 23 bp, Homo sapiens
  mature of SEQ ID 384
aatttccgggcagggggctgcaa

SEQ ID NO: 2260 - DNA, 27 bp, Homo sapiens
  mature of SEQ ID 385
aacactatatagaagttgtgcttacca

SEQ ID NO: 2261 - DNA, 33 bp, Homo sapiens
  mature of SEQ ID 386
ggagaccacaattataccccctttcaatgacat

SEQ ID NO: 2262 - DNA, 35 bp, Homo sapiens
  mature of SEQ ID 386
caattataccccctttcaatgacatgtctggggtt

SEQ ID NO: 2263 - DNA, 25 bp, Homo sapiens
  mature of SEQ ID 386
ctccagacaaagaagctgaaatgta

SEQ ID NO: 2264 - DNA, 32 bp, Homo sapiens
  mature of SEQ ID 387
cccaagagattgtaattcgcttaattatttgg

SEQ ID NO: 2265 - DNA, 30 bp, Homo sapiens
  mature of SEQ ID 387
cttcagtaattacaatttttaatggctgaa

SEQ ID NO: 2266 - DNA, 19 bp, Homo sapiens
  mature of SEQ ID 388
tcattatttctaaacttag

SEQ ID NO: 2267 - DNA, 27 bp, Homo sapiens
  mature of SEQ ID 389
gaacattgacattaacaaggcaggtgg

SEQ ID NO: 2268 - DNA, 19 bp, Homo sapiens
  mature of SEQ ID 390
aggtgatggtcgagcgctt

SEQ ID NO: 2269 - DNA, 34 bp, Homo sapiens
  mature of SEQ ID 390
caggcagcagcaggcgcacggccgtctggatctc

SEQ ID NO: 2270 - DNA, 25 bp, Homo sapiens
  mature of SEQ ID 391
ttataatagattacaggaagatgct

SEQ ID NO: 2271 - DNA, 20 bp, Homo sapiens
  mature of SEQ ID 393
gaattttaattgaatatatt

SEQ ID NO: 2272 - DNA, 31 bp, Homo sapiens
  mature of SEQ ID 394
tgagagataaacactttggtacatattggag

SEQ ID NO: 2273 - DNA, 29 bp, Homo sapiens
  mature of SEQ ID 394
gtgttgagagataaacactttggtacata

SEQ ID NO: 2274 - DNA, 30 bp, Homo sapiens
  mature of SEQ ID 395
tagccctgctgttttgctggagaaacacag

SEQ ID NO: 2275 - DNA, 26 bp, Homo sapiens
  mature of SEQ ID 396
ttctcacagtgttaagcatctgggct

SEQ ID NO: 2276 - DNA, 28 bp, Homo sapiens
  mature of SEQ ID 398
gctgttctttccaaataaatccttcaga

SEQ ID NO: 2277 - DNA, 25 bp, Homo sapiens
  mature of SEQ ID 399
ggctatttgtgtgtgatcagtaaat

SEQ ID NO: 2278 - DNA, 25 bp, Homo sapiens
  mature of SEQ ID 400
cttcagccaatctgtgataaaaggg

SEQ ID NO: 2279 - DNA, 31 bp, Homo sapiens
  mature of SEQ ID 400
ttatatcgacagttggtagcacaagcctttt

SEQ ID NO: 2280 - DNA, 29 bp, Homo sapiens
  mature of SEQ ID 400
ccttttatatcgacagttggtagcacaag

SEQ ID NO: 2281 - DNA, 22 bp, Homo sapiens
  mature of SEQ ID 401
ttttaatttcactatttcaatt

SEQ ID NO: 2282 - DNA, 34 bp, Homo sapiens
  mature of SEQ ID 402
tcattttgtattgaatgatttttaatgaatgcaa

SEQ ID NO: 2283 - DNA, 28 bp, Homo sapiens
  mature of SEQ ID 402
ttgcagatgagcaataatcattaaaatc

SEQ ID NO: 2284 - DNA, 31 bp, Homo sapiens
  mature of SEQ ID 403
taatggcatgagtggactcagtattacaaag

SEQ ID NO: 2285 - DNA, 26 bp, Homo sapiens
  mature of SEQ ID 404
ttagatgaggctgtaacttgtggagt

SEQ ID NO: 2286 - DNA, 20 bp, Homo sapiens
  mature of SEQ ID 405
cagcagcagaaaactcagtg

SEQ ID NO: 2287 - DNA, 32 bp, Homo sapiens
  mature of SEQ ID 408
gagaaacttgaaatttataaaagaaccctgga

SEQ ID NO: 2288 - DNA, 19 bp, Homo sapiens
  mature of SEQ ID 408
tccaggttcattttgcaaa

SEQ ID NO: 2289 - DNA, 31 bp, Homo sapiens
  mature of SEQ ID 409
tgcttcttctcttgctttgtctctggtctgt

SEQ ID NO: 2290 - DNA, 26 bp, Homo sapiens
  mature of SEQ ID 410
gacatgacaggcatatggtgtttatc

SEQ ID NO: 2291 - DNA, 26 bp, Homo sapiens
  mature of SEQ ID 412
cggtatttctagaaacattacaaatt

SEQ ID NO: 2292 - DNA, 23 bp, Homo sapiens
  mature of SEQ ID 412
ctatgtaaaatttgggaactaga

SEQ ID NO: 2293 - DNA, 20 bp, Homo sapiens
  mature of SEQ ID 413
cctgtgcccaagaagctact

SEQ ID NO: 2294 - DNA, 19 bp, Homo sapiens
  mature of SEQ ID 414
catgcctagcaggagcttg

SEQ ID NO: 2295 - DNA, 19 bp, Homo sapiens
  mature of SEQ ID 414
gtattaaaatggaatttct

SEQ ID NO: 2296 - DNA, 21 bp, Homo sapiens
  mature of SEQ ID 414
cggcagctggaagaccataaa

SEQ ID NO: 2297 - DNA, 29 bp, Homo sapiens
  mature of SEQ ID 416
ctgatgccgggggagttatgtcatctgct

SEQ ID NO: 2298 - DNA, 32 bp, Homo sapiens
  mature of SEQ ID 416
aattagcacatgagtaataccaagcccattag

SEQ ID NO: 2299 - DNA, 30 bp, Homo sapiens
  mature of SEQ ID 416
caatcaattagcacatgagtaataccaagc

SEQ ID NO: 2300 - DNA, 33 bp, Homo sapiens
  mature of SEQ ID 417
taattagcattaatttgtttgctgaggtagatg

SEQ ID NO: 2301 - DNA, 31 bp, Homo sapiens
  mature of SEQ ID 417
catttactcacaatttaattgcatttttaat

SEQ ID NO: 2302 - DNA, 33 bp, Homo sapiens
  mature of SEQ ID 417
ctcacaatttaattgcatttttaatgctaatta

SEQ ID NO: 2303 - DNA, 19 bp, Homo sapiens
  mature of SEQ ID 419
gccccttctaaggagtttc

SEQ ID NO: 2304 - DNA, 24 bp, Homo sapiens
  mature of SEQ ID 420
ccaattaggcaggggccagagggc

SEQ ID NO: 2305 - DNA, 19 bp, Homo sapiens
  mature of SEQ ID 420
ctctcaacctacattagct

SEQ ID NO: 2306 - DNA, 31 bp, Homo sapiens
  mature of SEQ ID 421
taataacacacactttgtagtgcctagagtt

SEQ ID NO: 2307 - DNA, 34 bp, Homo sapiens
  mature of SEQ ID 421
cacacactttgtagtgcctagagttgtttttaat

SEQ ID NO: 2308 - DNA, 31 bp, Homo sapiens
  mature of SEQ ID 422
ttataaattgtctcatttgcagctatttaat

SEQ ID NO: 2309 - DNA, 29 bp, Homo sapiens
  mature of SEQ ID 422
tgggttataaattgtctcatttgcagcta

SEQ ID NO: 2310 - DNA, 32 bp, Homo sapiens
  mature of SEQ ID 422
ttatttgcttttgagaaacaattttccaccca

SEQ ID NO: 2311 - DNA, 30 bp, Homo sapiens
  mature of SEQ ID 422
attacttatttgcttttgagaaacaatttt

SEQ ID NO: 2312 - DNA, 23 bp, Homo sapiens
  mature of SEQ ID 423
taatattcatttagccttctgag

SEQ ID NO: 2313 - DNA, 29 bp, Homo sapiens
  mature of SEQ ID 425
catttgattacaagcctcattcagtacag

SEQ ID NO: 2314 - DNA, 28 bp, Homo sapiens
  mature of SEQ ID 425
gctactgttgtgaatgataatcaagtag

SEQ ID NO: 2315 - DNA, 32 bp, Homo sapiens
  mature of SEQ ID 426
tctgtgtttaatttcttcaaaatgtatatatt

SEQ ID NO: 2316 - DNA, 30 bp, Homo sapiens
  mature of SEQ ID 426
aaagttctgtgtttaatttcttcaaaatgt

SEQ ID NO: 2317 - DNA, 34 bp, Homo sapiens
  mature of SEQ ID 426
tgtatttgttcatgtttggtgcatagaactgggt

SEQ ID NO: 2318 - DNA, 19 bp, Homo sapiens
  mature of SEQ ID 427
agccctctgtgacacatca

SEQ ID NO: 2319 - DNA, 32 bp, Homo sapiens
  mature of SEQ ID 427
actgcacagatctcaaataaggaaggggagcg

SEQ ID NO: 2320 - DNA, 29 bp, Homo sapiens
  mature of SEQ ID 427
tgagactgcacagatctcaaataaggaag

SEQ ID NO: 2321 - DNA, 32 bp, Homo sapiens
  mature of SEQ ID 428
gtttttatttgcatttatagatataatttgct

SEQ ID NO: 2322 - DNA, 29 bp, Homo sapiens
  mature of SEQ ID 428
agatgtttttatttgcatttatagatata

SEQ ID NO: 2323 - DNA, 20 bp, Homo sapiens
  mature of SEQ ID 428
agcaacatatttatgattaa

SEQ ID NO: 2324 - DNA, 31 bp, Homo sapiens
  mature of SEQ ID 429
aaaatgtcaagataattatatgttaaatatt

SEQ ID NO: 2325 - DNA, 34 bp, Homo sapiens
  mature of SEQ ID 430
agacaattttatggggataatttcttggcaaagt

SEQ ID NO: 2326 - DNA, 19 bp, Homo sapiens
  mature of SEQ ID 431
aggtgatgcctttgttctt

SEQ ID NO: 2327 - DNA, 19 bp, Homo sapiens
  mature of SEQ ID 431
ggattctccaaatactcca

SEQ ID NO: 2328 - DNA, 21 bp, Homo sapiens
  mature of SEQ ID 432
aatgtgctgagctagtggtaa

SEQ ID NO: 2329 - DNA, 31 bp, Homo sapiens
  mature of SEQ ID 433
gctggaacagctcaaaattgaataattaatt

SEQ ID NO: 2330 - DNA, 34 bp, Homo sapiens
  mature of SEQ ID 433
acagctcaaaattgaataattaattacactcagc

SEQ ID NO: 2331 - DNA, 23 bp, Homo sapiens
  mature of SEQ ID 433
gcagtgactaattgatcaggggc

SEQ ID NO: 2332 - DNA, 19 bp, Homo sapiens
  mature of SEQ ID 434
cagatattattcagtctta

SEQ ID NO: 2333 - DNA, 29 bp, Homo sapiens
  mature of SEQ ID 434
gattttgttgtaacttaaggtatcttgct

SEQ ID NO: 2334 - DNA, 31 bp, Homo sapiens
  mature of SEQ ID 435
gccagaaaacattattaatttcagaagtgga

SEQ ID NO: 2335 - DNA, 31 bp, Homo sapiens
  mature of SEQ ID 435
tgttacttcccctttgtggtaatggcttgtg

SEQ ID NO: 2336 - DNA, 23 bp, Homo sapiens
  mature of SEQ ID 436
gatttatctgatccagatgtgtg

SEQ ID NO: 2337 - DNA, 20 bp, Homo sapiens
  mature of SEQ ID 439
taatgaaattgcattcctat

SEQ ID NO: 2338 - DNA, 32 bp, Homo sapiens
  mature of SEQ ID 439
aaggtgcagttattatttactggagctttcca

SEQ ID NO: 2339 - DNA, 29 bp, Homo sapiens
  mature of SEQ ID 439
atataaggtgcagttattatttactggag

SEQ ID NO: 2340 - DNA, 21 bp, Homo sapiens
  mature of SEQ ID 440
ctgttccttggtttgtaaaca

SEQ ID NO: 2341 - DNA, 30 bp, Homo sapiens
  mature of SEQ ID 441
atgtgttcctgacatatttcagagaccagg

SEQ ID NO: 2342 - DNA, 33 bp, Homo sapiens
  mature of SEQ ID 441
ttcctgacatatttcagagaccaggcttgtcat

SEQ ID NO: 2343 - DNA, 26 bp, Homo sapiens
  mature of SEQ ID 443
ttaacaaatattgctttaaactatta

SEQ ID NO: 2344 - DNA, 29 bp, Homo sapiens
  mature of SEQ ID 445
tgtagtctgttgaatagtatttaccatgg

SEQ ID NO: 2345 - DNA, 29 bp, Homo sapiens
  mature of SEQ ID 446
tttggcctctagactatactgtaccaaag

SEQ ID NO: 2346 - DNA, 21 bp, Homo sapiens
  mature of SEQ ID 446
tatagtcaatttacttaaaat

SEQ ID NO: 2347 - DNA, 35 bp, Homo sapiens
  mature of SEQ ID 447
aggcacagaaagctgaaggtgctagagatgccaag

SEQ ID NO: 2348 - DNA, 32 bp, Homo sapiens
  mature of SEQ ID 447
acagaccaggcacagaaagctgaaggtgctag

SEQ ID NO: 2349 - DNA, 24 bp, Homo sapiens
  mature of SEQ ID 447
taactgtgtacttctggtgactgt

SEQ ID NO: 2350 - DNA, 29 bp, Homo sapiens
  mature of SEQ ID 448
catcacttaaaaaagaatgtagtgctata

SEQ ID NO: 2351 - DNA, 24 bp, Homo sapiens
  mature of SEQ ID 449
gggtacattagttgaagtggctac

SEQ ID NO: 2352 - DNA, 31 bp, Homo sapiens
  mature of SEQ ID 450
tgagatttatgctgattctcttgattcagtc

SEQ ID NO: 2353 - DNA, 33 bp, Homo sapiens
  mature of SEQ ID 450
ttatgctgattctcttgattcagtccagacttg

SEQ ID NO: 2354 - DNA, 22 bp, Homo sapiens
  mature of SEQ ID 450
tgttccataaattactgcagcc

SEQ ID NO: 2355 - DNA, 19 bp, Homo sapiens
  mature of SEQ ID 451
cagagaatttataattagc

SEQ ID NO: 2356 - DNA, 29 bp, Homo sapiens
  mature of SEQ ID 451
taataaattctttggaaagatggttttaa

SEQ ID NO: 2357 - DNA, 31 bp, Homo sapiens
  mature of SEQ ID 451
aaattctttggaaagatggttttaattagca

SEQ ID NO: 2358 - DNA, 25 bp, Homo sapiens
  mature of SEQ ID 452
tagtaatttatttttaatatctttc

SEQ ID NO: 2359 - DNA, 23 bp, Homo sapiens
  mature of SEQ ID 452
aaaaatagataataacagcattg

SEQ ID NO: 2360 - DNA, 33 bp, Homo sapiens
  mature of SEQ ID 453
ccaggcacagaaagctgaaggtgctggagatgc

SEQ ID NO: 2361 - DNA, 30 bp, Homo sapiens
  mature of SEQ ID 453
acagaccaggcacagaaagctgaaggtgct

SEQ ID NO: 2362 - DNA, 22 bp, Homo sapiens
  mature of SEQ ID 453
actgtgtacttctggtgactgt

SEQ ID NO: 2363 - DNA, 19 bp, Homo sapiens
  mature of SEQ ID 454
ggctcatcacagttggatg

SEQ ID NO: 2364 - DNA, 23 bp, Homo sapiens
  mature of SEQ ID 455
ccccgcccgcgcgcgatcaattg

SEQ ID NO: 2365 - DNA, 28 bp, Homo sapiens
  mature of SEQ ID 455
cgataattgcgcgccggcagctgcgagc

SEQ ID NO: 2366 - DNA, 25 bp, Homo sapiens
  mature of SEQ ID 456
tgaattaaaaacaaacctactggga

SEQ ID NO: 2367 - DNA, 23 bp, Homo sapiens
  mature of SEQ ID 457
ctgccaatgcccatctatggttt

SEQ ID NO: 2368 - DNA, 26 bp, Homo sapiens
  mature of SEQ ID 458
agaaactaagagaaagtgtcaggagc

SEQ ID NO: 2369 - DNA, 29 bp, Homo sapiens
  mature of SEQ ID 459
tgcatttttctgtgtttctttctaaccct

SEQ ID NO: 2370 - DNA, 23 bp, Homo sapiens
  mature of SEQ ID 459
agaatttaggaagagagccacag

SEQ ID NO: 2371 - DNA, 33 bp, Homo sapiens
  mature of SEQ ID 461
taatgcttaaaagaaggctagcattgtttgcac

SEQ ID NO: 2372 - DNA, 29 bp, Homo sapiens
  mature of SEQ ID 461
gtgtagaattattgcttatgtcatttctt

SEQ ID NO: 2373 - DNA, 23 bp, Homo sapiens
  mature of SEQ ID 462
tgtatattgattgtggcaaagtt

SEQ ID NO: 2374 - DNA, 26 bp, Homo sapiens
  mature of SEQ ID 462
tcatcttttatttggtaaattatgaa

SEQ ID NO: 2375 - DNA, 30 bp, Homo sapiens
  mature of SEQ ID 463
tgtataatttcaggaacaagcaggtttaga

SEQ ID NO: 2376 - DNA, 21 bp, Homo sapiens
  mature of SEQ ID 463
tcttgatttgcttcattgtcc

SEQ ID NO: 2377 - DNA, 19 bp, Homo sapiens
  mature of SEQ ID 465
cggctccaggttctgcctc

SEQ ID NO: 2378 - DNA, 35 bp, Homo sapiens
  mature of SEQ ID 467
gtccccactctcattttgtggcggtgacattaccg

SEQ ID NO: 2379 - DNA, 33 bp, Homo sapiens
  mature of SEQ ID 467
gtgcttaagtccccactctcattttgtggcggt

SEQ ID NO: 2380 - DNA, 31 bp, Homo sapiens
  mature of SEQ ID 467
tggctctaatactctcataatttgaaagggg

SEQ ID NO: 2381 - DNA, 33 bp, Homo sapiens
  mature of SEQ ID 467
taatactctcataatttgaaaggggatttgcat

SEQ ID NO: 2382 - DNA, 34 bp, Homo sapiens
  mature of SEQ ID 468
ggtttcctctttaaattaagaatactaatgattt

SEQ ID NO: 2383 - DNA, 32 bp, Homo sapiens
  mature of SEQ ID 468
gtccaaaggtttcctctttaaattaagaatac

SEQ ID NO: 2384 - DNA, 30 bp, Homo sapiens
  mature of SEQ ID 469
cgggagggttaacagcccgattgtaaaatc

SEQ ID NO: 2385 - DNA, 33 bp, Homo sapiens
  mature of SEQ ID 469
gggttaacagcccgattgtaaaatcaatgtcat

SEQ ID NO: 2386 - DNA, 26 bp, Homo sapiens
  mature of SEQ ID 470
gaggtcctcattaactctgatcttca

SEQ ID NO: 2387 - DNA, 23 bp, Homo sapiens
  mature of SEQ ID 470
agcctgcttctgtaattgtgcag

SEQ ID NO: 2388 - DNA, 31 bp, Homo sapiens
  mature of SEQ ID 471
tctttgctttcttttcagagatttatggaga

SEQ ID NO: 2389 - DNA, 35 bp, Homo sapiens
  mature of SEQ ID 472
aaggcactcgggcagcacaaagggagcagatgccc

SEQ ID NO: 2390 - DNA, 32 bp, Homo sapiens
  mature of SEQ ID 472
cagggggaaggcactcgggcagcacaaaggga

SEQ ID NO: 2391 - DNA, 31 bp, Homo sapiens
  mature of SEQ ID 473
agtatatattttatgaacattctttcctcaa

SEQ ID NO: 2392 - DNA, 32 bp, Homo sapiens
  mature of SEQ ID 474
ttggcatttcctgtgttggctttggctggtga

SEQ ID NO: 2393 - DNA, 23 bp, Homo sapiens
  mature of SEQ ID 477
ttggtttgctgtttggtaaagca

SEQ ID NO: 2394 - DNA, 36 bp, Homo sapiens
  mature of SEQ ID 477
aatattagcatttttgctttcaacagcaattagcaa

SEQ ID NO: 2395 - DNA, 34 bp, Homo sapiens
  mature of SEQ ID 477
gtgacttttaatattagcatttttgctttcaaca

SEQ ID NO: 2396 - DNA, 19 bp, Homo sapiens
  mature of SEQ ID 478
gggtccgggtctctaccgc

SEQ ID NO: 2397 - DNA, 24 bp, Homo sapiens
  mature of SEQ ID 479
gatggcatcaaaggtggccttggc

SEQ ID NO: 2398 - DNA, 33 bp, Homo sapiens
  mature of SEQ ID 480
attcagtgagaatactttgggtttcaggaaata

SEQ ID NO: 2399 - DNA, 20 bp, Homo sapiens
  mature of SEQ ID 481
gtgtgaagtcacaggaaggg

SEQ ID NO: 2400 - DNA, 30 bp, Homo sapiens
  mature of SEQ ID 483
ttctgatgatctattaatgcaatacatcag

SEQ ID NO: 2401 - DNA, 30 bp, Homo sapiens
  mature of SEQ ID 484
gcttttttggaggcctttcaaactgcctta

SEQ ID NO: 2402 - DNA, 32 bp, Homo sapiens
  mature of SEQ ID 484
tttggaggcctttcaaactgccttaaggggtt

SEQ ID NO: 2403 - DNA, 25 bp, Homo sapiens
  mature of SEQ ID 485
cacatttattattgcccacaggaaa

SEQ ID NO: 2404 - DNA, 26 bp, Homo sapiens
  mature of SEQ ID 486
acagctccataaatgtttaatgccac

SEQ ID NO: 2405 - DNA, 19 bp, Homo sapiens
  mature of SEQ ID 486
tgaggcaggtgctgaaaca

SEQ ID NO: 2406 - DNA, 34 bp, Homo sapiens
  mature of SEQ ID 488
agcctggcgtgacggattaaacatcaactagtta

SEQ ID NO: 2407 - DNA, 33 bp, Homo sapiens
  mature of SEQ ID 488
taactggttttgtgtcaggaagatctttctcgc

SEQ ID NO: 2408 - DNA, 30 bp, Homo sapiens
  mature of SEQ ID 489
gctattaatctctgtggtcaggcctgtaaa

SEQ ID NO: 2409 - DNA, 32 bp, Homo sapiens
  mature of SEQ ID 489
taatctctgtggtcaggcctgtaaagctggtc

SEQ ID NO: 2410 - DNA, 34 bp, Homo sapiens
  mature of SEQ ID 489
agcccaggttcacatggttaccacattatttggc

SEQ ID NO: 2411 - DNA, 23 bp, Homo sapiens
  mature of SEQ ID 490
aagtgttatttcaaactgacatc

SEQ ID NO: 2412 - DNA, 20 bp, Homo sapiens
  mature of SEQ ID 490
tctcttgacatttcaaagat

SEQ ID NO: 2413 - DNA, 25 bp, Homo sapiens
  mature of SEQ ID 491
gtcaaaagactataaatgctttgca

SEQ ID NO: 2414 - DNA, 33 bp, Homo sapiens
  mature of SEQ ID 491
gaaattattttgcttctatttatagcctctgtc

SEQ ID NO: 2415 - DNA, 21 bp, Homo sapiens
  mature of SEQ ID 492
tcaggaatgtatataactgaa

SEQ ID NO: 2416 - DNA, 31 bp, Homo sapiens
  mature of SEQ ID 492
tctttattttgatgatatatttttgtaagga

SEQ ID NO: 2417 - DNA, 34 bp, Homo sapiens
  mature of SEQ ID 493
tcccacttgctggcagtatatcatggcacagttt

SEQ ID NO: 2418 - DNA, 20 bp, Homo sapiens
  mature of SEQ ID 493
gagctgtgagctaactggga

SEQ ID NO: 2419 - DNA, 25 bp, Homo sapiens
  mature of SEQ ID 494
cttgttagacaatcacagctggggg

SEQ ID NO: 2420 - DNA, 26 bp, Homo sapiens
  mature of SEQ ID 494
gcctttgttcagcccccagttatgtg

SEQ ID NO: 2421 - DNA, 23 bp, Homo sapiens
  mature of SEQ ID 495
gcaagagtgcgcccactactgga

SEQ ID NO: 2422 - DNA, 23 bp, Homo sapiens
  mature of SEQ ID 496
ataatgtgcactcatgtagttga

SEQ ID NO: 2423 - DNA, 23 bp, Homo sapiens
  mature of SEQ ID 496
tgcttgcacagggctggaatgtc

SEQ ID NO: 2424 - DNA, 20 bp, Homo sapiens
  mature of SEQ ID 498
ggccaggaaggcgtgggtgg

SEQ ID NO: 2425 - DNA, 19 bp, Homo sapiens
  mature of SEQ ID 499
tctctggtattgaagaggt

SEQ ID NO: 2426 - DNA, 29 bp, Homo sapiens
  mature of SEQ ID 499
atgtttacaaaccaaggaacagtgatcca

SEQ ID NO: 2427 - DNA, 31 bp, Homo sapiens
  mature of SEQ ID 500
gaaagcaagcgtgagatcatttcatcagcgt

SEQ ID NO: 2428 - DNA, 29 bp, Homo sapiens
  mature of SEQ ID 500
cttagaaagcaagcgtgagatcatttcat

SEQ ID NO: 2429 - DNA, 33 bp, Homo sapiens
  mature of SEQ ID 500
tttgaagggtctctgttttctctcttaatttgg

SEQ ID NO: 2430 - DNA, 31 bp, Homo sapiens
  mature of SEQ ID 500
atgctgtttgaagggtctctgttttctctct

SEQ ID NO: 2431 - DNA, 30 bp, Homo sapiens
  mature of SEQ ID 501
ggctaattagaataccaattagaactggca

SEQ ID NO: 2432 - DNA, 33 bp, Homo sapiens
  mature of SEQ ID 501
attagaataccaattagaactggcagggctatc

SEQ ID NO: 2433 - DNA, 35 bp, Homo sapiens
  mature of SEQ ID 501
tttgttaaaaagtttaatgttcttaattagttgaa

SEQ ID NO: 2434 - DNA, 32 bp, Homo sapiens
  mature of SEQ ID 501
gatagcctttgttaaaaagtttaatgttctta

SEQ ID NO: 2435 - DNA, 22 bp, Homo sapiens
  mature of SEQ ID 502
acagttctgtgtgaacaccctg

SEQ ID NO: 2436 - DNA, 29 bp, Homo sapiens
  mature of SEQ ID 502
tccttctactgtgtcaaccacacagtgct

SEQ ID NO: 2437 - DNA, 30 bp, Homo sapiens
  mature of SEQ ID 503
agaagcaataagaactgggtattggcttaa

SEQ ID NO: 2438 - DNA, 32 bp, Homo sapiens
  mature of SEQ ID 503
caataagaactgggtattggcttaatttgggg

SEQ ID NO: 2439 - DNA, 22 bp, Homo sapiens
  mature of SEQ ID 504
ctcactttttctgcttattcct

SEQ ID NO: 2440 - DNA, 23 bp, Homo sapiens
  mature of SEQ ID 505
catatggagtaactaaggtcatt

SEQ ID NO: 2441 - DNA, 19 bp, Homo sapiens
  mature of SEQ ID 507
ttagcccttctggtgtagg

SEQ ID NO: 2442 - DNA, 22 bp, Homo sapiens
  mature of SEQ ID 507
acaccagattatactcgtccca

SEQ ID NO: 2443 - DNA, 22 bp, Homo sapiens
  mature of SEQ ID 508
atttgttcagagtcacggccat

SEQ ID NO: 2444 - DNA, 26 bp, Homo sapiens
  mature of SEQ ID 509
gagcttcttcacagcctgtttgatct

SEQ ID NO: 2445 - DNA, 26 bp, Homo sapiens
  mature of SEQ ID 510
tctagtaaggatggccagggattttt

SEQ ID NO: 2446 - DNA, 31 bp, Homo sapiens
  mature of SEQ ID 510
tgtgattaatcccagggcatttggtatgaac

SEQ ID NO: 2447 - DNA, 33 bp, Homo sapiens
  mature of SEQ ID 510
taatcccagggcatttggtatgaaccaaagtgc

SEQ ID NO: 2448 - DNA, 19 bp, Homo sapiens
  mature of SEQ ID 511
gcagcagcccctgccagga

SEQ ID NO: 2449 - DNA, 22 bp, Homo sapiens
  mature of SEQ ID 511
ttttagctacagccccgtgtca

SEQ ID NO: 2450 - DNA, 31 bp, Homo sapiens
  mature of SEQ ID 512
acttgttcaaggttactttacccaccctcct

SEQ ID NO: 2451 - DNA, 29 bp, Homo sapiens
  mature of SEQ ID 512
gaccacttgttcaaggttactttacccac

SEQ ID NO: 2452 - DNA, 30 bp, Homo sapiens
  mature of SEQ ID 513
aattaatttagctttaaatagcagcactga

SEQ ID NO: 2453 - DNA, 33 bp, Homo sapiens
  mature of SEQ ID 513
atttagctttaaatagcagcactgagaatgttt

SEQ ID NO: 2454 - DNA, 29 bp, Homo sapiens
  mature of SEQ ID 513
gaggagagctaagcagaattaatgatggc

SEQ ID NO: 2455 - DNA, 19 bp, Homo sapiens
  mature of SEQ ID 514
agtaccaccaaacaatttg

SEQ ID NO: 2456 - DNA, 19 bp, Homo sapiens
  mature of SEQ ID 515
aaatttgtgttattattgt

SEQ ID NO: 2457 - DNA, 22 bp, Homo sapiens
  mature of SEQ ID 515
cttacactcaaagggccaggtg

SEQ ID NO: 2458 - DNA, 20 bp, Homo sapiens
  mature of SEQ ID 515
gggagtacataacatttttt

SEQ ID NO: 2459 - DNA, 21 bp, Homo sapiens
  mature of SEQ ID 517
ggagccagcagagggagctgt

SEQ ID NO: 2460 - DNA, 27 bp, Homo sapiens
  mature of SEQ ID 518
gttactgcccttgtctttatttgaccc

SEQ ID NO: 2461 - DNA, 21 bp, Homo sapiens
  mature of SEQ ID 518
gtgtttgcgcagtcaagtacc

SEQ ID NO: 2462 - DNA, 19 bp, Homo sapiens
  mature of SEQ ID 519
cctggacaccttcctcagt

SEQ ID NO: 2463 - DNA, 24 bp, Homo sapiens
  mature of SEQ ID 519
atgaggtaggtgggtcagagtctg

SEQ ID NO: 2464 - DNA, 31 bp, Homo sapiens
  mature of SEQ ID 521
agataaaattccatctgtggttaatggaaag

SEQ ID NO: 2465 - DNA, 27 bp, Homo sapiens
  mature of SEQ ID 522
ataacctttacctaccaaatcaggcat

SEQ ID NO: 2466 - DNA, 25 bp, Homo sapiens
  mature of SEQ ID 524
cctgaatattaatgaagccatctag

SEQ ID NO: 2467 - DNA, 20 bp, Homo sapiens
  mature of SEQ ID 525
tacgtgtgtgaggagtgcgg

SEQ ID NO: 2468 - DNA, 21 bp, Homo sapiens
  mature of SEQ ID 526
tggaccgttaagctgggcaaa

SEQ ID NO: 2469 - DNA, 28 bp, Homo sapiens
  mature of SEQ ID 527
gctcatacatatgcattgtttttagatt

SEQ ID NO: 2470 - DNA, 30 bp, Homo sapiens
  mature of SEQ ID 527
aatctgtagtcataagcagtgtgggtgaaa

SEQ ID NO: 2471 - DNA, 33 bp, Homo sapiens
  mature of SEQ ID 527
gtagtcataagcagtgtgggtgaaatacaaagt

SEQ ID NO: 2472 - DNA, 23 bp, Homo sapiens
  mature of SEQ ID 528
agcctggaaaatggtaaatgatc

SEQ ID NO: 2473 - DNA, 31 bp, Homo sapiens
  mature of SEQ ID 528
gatcaattacaggcttttagctggcttgtct

SEQ ID NO: 2474 - DNA, 25 bp, Homo sapiens
  mature of SEQ ID 529
gatcatggttttgattacaaatccc

SEQ ID NO: 2475 - DNA, 19 bp, Homo sapiens
  mature of SEQ ID 529
aaaacaattatggaaatga

SEQ ID NO: 2476 - DNA, 27 bp, Homo sapiens
  mature of SEQ ID 530
ggtgacaaaatttacatctttgtattc

SEQ ID NO: 2477 - DNA, 27 bp, Homo sapiens
  mature of SEQ ID 531
ttcctgctcccagagccataaagtggg

SEQ ID NO: 2478 - DNA, 33 bp, Homo sapiens
  mature of SEQ ID 532
actttattctggtatagaaagtattaaaagttg

SEQ ID NO: 2479 - DNA, 31 bp, Homo sapiens
  mature of SEQ ID 532
gacagaactttattctggtatagaaagtatt

SEQ ID NO: 2480 - DNA, 22 bp, Homo sapiens
  mature of SEQ ID 533
aggaggttttaggaggagaagg

SEQ ID NO: 2481 - DNA, 20 bp, Homo sapiens
  mature of SEQ ID 534
ttcttgtgtttcctcttctc

SEQ ID NO: 2482 - DNA, 19 bp, Homo sapiens
  mature of SEQ ID 534
tggagagggatgaaggaga

SEQ ID NO: 2483 - DNA, 26 bp, Homo sapiens
  mature of SEQ ID 535
gcctattcccaatgatattctgtctc

SEQ ID NO: 2484 - DNA, 30 bp, Homo sapiens
  mature of SEQ ID 537
aagcagatattaaaagatgacattgttgat

SEQ ID NO: 2485 - DNA, 25 bp, Homo sapiens
  mature of SEQ ID 538
ttcagatgaaggataaaatacttgg

SEQ ID NO: 2486 - DNA, 19 bp, Homo sapiens
  mature of SEQ ID 538
cattgttcccattcccaaa

SEQ ID NO: 2487 - DNA, 27 bp, Homo sapiens
  mature of SEQ ID 539
tggaatgctgtaaaaatttaattaggt

SEQ ID NO: 2488 - DNA, 34 bp, Homo sapiens
  mature of SEQ ID 540
gatgtcaatgagaataattgctttttaaattggg

SEQ ID NO: 2489 - DNA, 22 bp, Homo sapiens
  mature of SEQ ID 541
gggggtcaaaggggagttcttt

SEQ ID NO: 2490 - DNA, 30 bp, Homo sapiens
  mature of SEQ ID 541
gaagaattctgggagagacgccaactagag

SEQ ID NO: 2491 - DNA, 32 bp, Homo sapiens
  mature of SEQ ID 541
attctgggagagacgccaactagagcaagctg

SEQ ID NO: 2492 - DNA, 22 bp, Homo sapiens
  mature of SEQ ID 542
ccaatgcctctcacctcctcac

SEQ ID NO: 2493 - DNA, 25 bp, Homo sapiens
  mature of SEQ ID 542
gaagtgcggggttattgtgagtgac

SEQ ID NO: 2494 - DNA, 19 bp, Homo sapiens
  mature of SEQ ID 543
ttattgattacttaattag

SEQ ID NO: 2495 - DNA, 35 bp, Homo sapiens
  mature of SEQ ID 543
agctaatcagagagagatgtaggtatttaggagtc

SEQ ID NO: 2496 - DNA, 32 bp, Homo sapiens
  mature of SEQ ID 543
ctaagatagctaatcagagagagatgtaggta

SEQ ID NO: 2497 - DNA, 22 bp, Homo sapiens
  mature of SEQ ID 544
tttgagtaaatagaactgttct

SEQ ID NO: 2498 - DNA, 21 bp, Homo sapiens
  mature of SEQ ID 544
aattatacagatctatttata

SEQ ID NO: 2499 - DNA, 19 bp, Homo sapiens
  mature of SEQ ID 545
cattggtaatgcttttgtt

SEQ ID NO: 2500 - DNA, 24 bp, Homo sapiens
  mature of SEQ ID 545
tgggacagatttgatttggaaatt

SEQ ID NO: 2501 - DNA, 30 bp, Homo sapiens
  mature of SEQ ID 546
gtcactgaagtggttaaagctttgtttgtt

SEQ ID NO: 2502 - DNA, 33 bp, Homo sapiens
  mature of SEQ ID 546
tgaagtggttaaagctttgtttgtttgttttgt

SEQ ID NO: 2503 - DNA, 35 bp, Homo sapiens
  mature of SEQ ID 546
aatggctcttaatggattaagctttaggctttcac

SEQ ID NO: 2504 - DNA, 35 bp, Homo sapiens
  mature of SEQ ID 546
aatggattaagctttaggctttcaccaaagcagta

SEQ ID NO: 2505 - DNA, 27 bp, Homo sapiens
  mature of SEQ ID 546
gctttaggctttcaccaaagcagtaac

SEQ ID NO: 2506 - DNA, 30 bp, Homo sapiens
  mature of SEQ ID 547
tctatttaggctgcagctgttgctattatg

SEQ ID NO: 2507 - DNA, 32 bp, Homo sapiens
  mature of SEQ ID 547
ttaggctgcagctgttgctattatgttaataa

SEQ ID NO: 2508 - DNA, 24 bp, Homo sapiens
  mature of SEQ ID 547
accactgtatacaacaggttatgg

SEQ ID NO: 2509 - DNA, 20 bp, Homo sapiens
  mature of SEQ ID 548
ctgctaccatggcaacatca

SEQ ID NO: 2510 - DNA, 22 bp, Homo sapiens
  mature of SEQ ID 549
agctcctggcgcagcaggtggt

SEQ ID NO: 2511 - DNA, 20 bp, Homo sapiens
  mature of SEQ ID 551
taattgctgccaaacgtgtg

SEQ ID NO: 2512 - DNA, 29 bp, Homo sapiens
  mature of SEQ ID 552
ggatctcaagcaaagtgttcagaacagtc

SEQ ID NO: 2513 - DNA, 32 bp, Homo sapiens
  mature of SEQ ID 552
ctcaagcaaagtgttcagaacagtctctggca

SEQ ID NO: 2514 - DNA, 27 bp, Homo sapiens
  mature of SEQ ID 553
tggctgacccagctccagctgctgagt

SEQ ID NO: 2515 - DNA, 24 bp, Homo sapiens
  mature of SEQ ID 554
gagaatgttaacatacctatagat

SEQ ID NO: 2516 - DNA, 32 bp, Homo sapiens
  mature of SEQ ID 556
aggtaaattagaagttaattagagagaacatg

SEQ ID NO: 2517 - DNA, 28 bp, Homo sapiens
  mature of SEQ ID 556
cgtgttttcttgtctctgattgtaaaca

SEQ ID NO: 2518 - DNA, 34 bp, Homo sapiens
  mature of SEQ ID 557
aatattttataggaaggattttgatctatgattt

SEQ ID NO: 2519 - DNA, 20 bp, Homo sapiens
  mature of SEQ ID 560
ctctaatctttgtttataga

SEQ ID NO: 2520 - DNA, 29 bp, Homo sapiens
  mature of SEQ ID 561
ctttaatctgtgacttctgagaaagtgac

SEQ ID NO: 2521 - DNA, 22 bp, Homo sapiens
  mature of SEQ ID 562
tttattaaaagagttatttcag

SEQ ID NO: 2522 - DNA, 22 bp, Homo sapiens
  mature of SEQ ID 562
agaggaaggaaggggaaaaatg

SEQ ID NO: 2523 - DNA, 34 bp, Homo sapiens
  mature of SEQ ID 563
atgctaagaaatgacagctcagggacaaggagac

SEQ ID NO: 2524 - DNA, 31 bp, Homo sapiens
  mature of SEQ ID 564
gaattttcaatagatgcttttcagataagaa

SEQ ID NO: 2525 - DNA, 31 bp, Homo sapiens
  mature of SEQ ID 565
tggggttggatccccatggggcagcttttgg

SEQ ID NO: 2526 - DNA, 33 bp, Homo sapiens
  mature of SEQ ID 565
gttaacccaggaattggagcgatctaaacccta

SEQ ID NO: 2527 - DNA, 30 bp, Homo sapiens
  mature of SEQ ID 565
ccagtgttaacccaggaattggagcgatct

SEQ ID NO: 2528 - DNA, 22 bp, Homo sapiens
  mature of SEQ ID 566
gtgttcagttatatacactgaa

SEQ ID NO: 2529 - DNA, 36 bp, Homo sapiens
  mature of SEQ ID 567
attatgtactacagcctacaaaattattcttcatgc

SEQ ID NO: 2530 - DNA, 34 bp, Homo sapiens
  mature of SEQ ID 567
agcatgaccattatgtactacagcctacaaaatt

SEQ ID NO: 2531 - DNA, 20 bp, Homo sapiens
  mature of SEQ ID 568
agtgtcaacttaatcaatgg

SEQ ID NO: 2532 - DNA, 21 bp, Homo sapiens
  mature of SEQ ID 407
ggaacccacttaggtggcacc

SEQ ID NO: 2533 - DNA, 32 bp, Homo sapiens
  mature of SEQ ID 569
tcctccatctgcagcagcttttggcaaagaga

SEQ ID NO: 2534 - DNA, 30 bp, Homo sapiens
  mature of SEQ ID 569
ctggctcctccatctgcagcagcttttggc

SEQ ID NO: 2535 - DNA, 31 bp, Homo sapiens
  mature of SEQ ID 570
aaagtaattggatttagcttcctatttagca

SEQ ID NO: 2536 - DNA, 29 bp, Homo sapiens
  mature of SEQ ID 571
ggagttagagaggcatttttattgattaa

SEQ ID NO: 2537 - DNA, 20 bp, Homo sapiens
  mature of SEQ ID 571
agaggtgtctctttctctct

SEQ ID NO: 2538 - DNA, 33 bp, Homo sapiens
  mature of SEQ ID 576
gacggaatgtgcagctgctgggagccacatgtg

SEQ ID NO: 2539 - DNA, 20 bp, Homo sapiens
  mature of SEQ ID 577
atatactcagtgcaatatct

SEQ ID NO: 2540 - DNA, 20 bp, Homo sapiens
  mature of SEQ ID 577
aatttgttttgaaatataca

SEQ ID NO: 2541 - DNA, 28 bp, Homo sapiens
  mature of SEQ ID 578
aagtaagtaaaatatgccatgtattatg

SEQ ID NO: 2542 - DNA, 21 bp, Homo sapiens
  mature of SEQ ID 578
taatacagtatatctgatata

SEQ ID NO: 2543 - DNA, 28 bp, Homo sapiens
  mature of SEQ ID 579
ggggctttggttttgtgacctactcttg

SEQ ID NO: 2544 - DNA, 21 bp, Homo sapiens
  mature of SEQ ID 580
ttgatatttaatatttaataa

SEQ ID NO: 2545 - DNA, 26 bp, Homo sapiens
  mature of SEQ ID 581
catccttgcaataaacatattatgga

SEQ ID NO: 2546 - DNA, 34 bp, Homo sapiens
  mature of SEQ ID 582
ttgccctcgggttataaatgttattgcatttgtg

SEQ ID NO: 2547 - DNA, 27 bp, Homo sapiens
  mature of SEQ ID 582
cctcagcttgcaagcatcacaggatcc

SEQ ID NO: 2548 - DNA, 34 bp, Homo sapiens
  mature of SEQ ID 583
tgtttggaaagaataattttcattgtgggtgttc

SEQ ID NO: 2549 - DNA, 20 bp, Homo sapiens
  mature of SEQ ID 583
acctaacttattccaaaaca

SEQ ID NO: 2550 - DNA, 31 bp, Homo sapiens
  mature of SEQ ID 584
atcagagcctggaatggcatccgtttggtat

SEQ ID NO: 2551 - DNA, 29 bp, Homo sapiens
  mature of SEQ ID 584
agctatcagagcctggaatggcatccgtt

SEQ ID NO: 2552 - DNA, 34 bp, Homo sapiens
  mature of SEQ ID 584
agccccaagagttctaattaatatatatttagct

SEQ ID NO: 2553 - DNA, 31 bp, Homo sapiens
  mature of SEQ ID 584
gatgccagccccaagagttctaattaatata

SEQ ID NO: 2554 - DNA, 22 bp, Homo sapiens
  mature of SEQ ID 585
ctattgaaggaggaaatatggc

SEQ ID NO: 2555 - DNA, 24 bp, Homo sapiens
  mature of SEQ ID 586
aaaggtattactgtcagataaccc

SEQ ID NO: 2556 - DNA, 33 bp, Homo sapiens
  mature of SEQ ID 587
gagcaaaactgctaatcagtgcccacagatatt

SEQ ID NO: 2557 - DNA, 31 bp, Homo sapiens
  mature of SEQ ID 587
tgttttagggccttgatttatgcaacaagtt

SEQ ID NO: 2558 - DNA, 33 bp, Homo sapiens
  mature of SEQ ID 588
aattggattgtctgacttcctattcaattggta

SEQ ID NO: 2559 - DNA, 31 bp, Homo sapiens
  mature of SEQ ID 588
aactgtaattggattgtctgacttcctattc

SEQ ID NO: 2560 - DNA, 24 bp, Homo sapiens
  mature of SEQ ID 591
tttcctaaccatgagaagcagact

SEQ ID NO: 2561 - DNA, 19 bp, Homo sapiens
  mature of SEQ ID 591
atggagttgtagtagaaaa

SEQ ID NO: 2562 - DNA, 32 bp, Homo sapiens
  mature of SEQ ID 593
tagattaatgcttcaaagtgtcaatttaattt

SEQ ID NO: 2563 - DNA, 35 bp, Homo sapiens
  mature of SEQ ID 593
atgcttcaaagtgtcaatttaatttctgttttact

SEQ ID NO: 2564 - DNA, 32 bp, Homo sapiens
  mature of SEQ ID 593
acaaatagcagatgttgatgaatattaatttg

SEQ ID NO: 2565 - DNA, 29 bp, Homo sapiens
  mature of SEQ ID 593
ctgaacaaatagcagatgttgatgaatat

SEQ ID NO: 2566 - DNA, 19 bp, Homo sapiens
  mature of SEQ ID 594
aatgactttatgtcaccta

SEQ ID NO: 2567 - DNA, 34 bp, Homo sapiens
  mature of SEQ ID 594
tgaccttttaaaactccagtgtgaatatctcatt

SEQ ID NO: 2568 - DNA, 29 bp, Homo sapiens
  mature of SEQ ID 595
ggagacaggacatagtcccagaggttgag

SEQ ID NO: 2569 - DNA, 32 bp, Homo sapiens
  mature of SEQ ID 595
acaggacatagtcccagaggttgagctggctt

SEQ ID NO: 2570 - DNA, 20 bp, Homo sapiens
  mature of SEQ ID 595
gagcccacaaaagactcagc

SEQ ID NO: 2571 - DNA, 21 bp, Homo sapiens
  mature of SEQ ID 597
gaaaatgaaacttttcactct

SEQ ID NO: 2572 - DNA, 33 bp, Homo sapiens
  mature of SEQ ID 598
aagcagagttcaccagtgagctcaggtgtctca

SEQ ID NO: 2573 - DNA, 32 bp, Homo sapiens
  mature of SEQ ID 598
gaacatggactgagcttgtggtgtgctttgca

SEQ ID NO: 2574 - DNA, 34 bp, Homo sapiens
  mature of SEQ ID 599
tcttttacgactgctaaatgcctgcctttctccc

SEQ ID NO: 2575 - DNA, 25 bp, Homo sapiens
  mature of SEQ ID 600
aagtggtcacagcagttaggttctt

SEQ ID NO: 2576 - DNA, 21 bp, Homo sapiens
  mature of SEQ ID 601
tcatgctatcagggtacatgt

SEQ ID NO: 2577 - DNA, 19 bp, Homo sapiens
  mature of SEQ ID 602
gaataatgtcgtgagagtc

SEQ ID NO: 2578 - DNA, 20 bp, Homo sapiens
  mature of SEQ ID 602
gcccataaaagcttagtttc

SEQ ID NO: 2579 - DNA, 19 bp, Homo sapiens
  mature of SEQ ID 603
ctggagcagtcagctggtg

SEQ ID NO: 2580 - DNA, 33 bp, Homo sapiens
  mature of SEQ ID 604
atcaactctcccagctggccattaatcccctag

SEQ ID NO: 2581 - DNA, 30 bp, Homo sapiens
  mature of SEQ ID 605
gcacagtgatcactcactcaaattaacaaa

SEQ ID NO: 2582 - DNA, 32 bp, Homo sapiens
  mature of SEQ ID 605
gtgatcactcactcaaattaacaaatcatttt

SEQ ID NO: 2583 - DNA, 23 bp, Homo sapiens
  mature of SEQ ID 606
tgtttccctgtggaaaagattac

SEQ ID NO: 2584 - DNA, 32 bp, Homo sapiens
  mature of SEQ ID 608
gaggagagataattcttcaatgtgggacacat

SEQ ID NO: 2585 - DNA, 34 bp, Homo sapiens
  mature of SEQ ID 608
gataattcttcaatgtgggacacatctgggagcc

SEQ ID NO: 2586 - DNA, 33 bp, Homo sapiens
  mature of SEQ ID 608
ggccctgagagcaatactcatattgattgcatt

SEQ ID NO: 2587 - DNA, 35 bp, Homo sapiens
  mature of SEQ ID 608
gagcaatactcatattgattgcatttatttcactc

SEQ ID NO: 2588 - DNA, 32 bp, Homo sapiens
  mature of SEQ ID 609
tctctcagttactcacaaaacatggctgtctt

SEQ ID NO: 2589 - DNA, 30 bp, Homo sapiens
  mature of SEQ ID 609
ctctctctctcagttactcacaaaacatgg

SEQ ID NO: 2590 - DNA, 21 bp, Homo sapiens
  mature of SEQ ID 610
ttgagctaatcctggaaattc

SEQ ID NO: 2591 - DNA, 25 bp, Homo sapiens
  mature of SEQ ID 611
ggctaattgttgcaggcaattaata

SEQ ID NO: 2592 - DNA, 20 bp, Homo sapiens
  mature of SEQ ID 611
agctgtaattggctccctct

SEQ ID NO: 2593 - DNA, 25 bp, Homo sapiens
  mature of SEQ ID 612
agtctgtttaaaatggcctagaaag

SEQ ID NO: 2594 - DNA, 25 bp, Homo sapiens
  mature of SEQ ID 612
gctttaatctgatgtctaggctgca

SEQ ID NO: 2595 - DNA, 19 bp, Homo sapiens
  mature of SEQ ID 613
ccattacaggataatgcac

SEQ ID NO: 2596 - DNA, 31 bp, Homo sapiens
  mature of SEQ ID 613
gttcttgtttttcctagtagcagatggtgct

SEQ ID NO: 2597 - DNA, 32 bp, Homo sapiens
  mature of SEQ ID 614
gattgaacacagactgtatttgttcttatcct

SEQ ID NO: 2598 - DNA, 30 bp, Homo sapiens
  mature of SEQ ID 614
gaatagattgaacacagactgtatttgttc

SEQ ID NO: 2599 - DNA, 25 bp, Homo sapiens
  mature of SEQ ID 615
atacagcattggttcctctagatct

SEQ ID NO: 2600 - DNA, 29 bp, Homo sapiens
  mature of SEQ ID 616
gatgtctccatggtacttctcattagcat

SEQ ID NO: 2601 - DNA, 34 bp, Homo sapiens
  mature of SEQ ID 617
cttatttatttcatgacaagggaaacaactttca

SEQ ID NO: 2602 - DNA, 25 bp, Homo sapiens
  mature of SEQ ID 617
cttgacacctttgtcaataaaatct

SEQ ID NO: 2603 - DNA, 20 bp, Homo sapiens
  mature of SEQ ID 618
cgtgtcttgttcagtaactc

SEQ ID NO: 2604 - DNA, 19 bp, Homo sapiens
  mature of SEQ ID 620
aagcaagtaattccatgtt

SEQ ID NO: 2605 - DNA, 23 bp, Homo sapiens
  mature of SEQ ID 623
gcatgttctgctcctttgagacc

SEQ ID NO: 2606 - DNA, 21 bp, Homo sapiens
  mature of SEQ ID 624
ctgtcaatgagtaatttatct

SEQ ID NO: 2607 - DNA, 30 bp, Homo sapiens
  mature of SEQ ID 626
tgggcacatgccatatgttttgaaggaaga

SEQ ID NO: 2608 - DNA, 32 bp, Homo sapiens
  mature of SEQ ID 626
acatgccatatgttttgaaggaagatgataag

SEQ ID NO: 2609 - DNA, 25 bp, Homo sapiens
  mature of SEQ ID 627
tgagagtctcttaagctagatttat

SEQ ID NO: 2610 - DNA, 23 bp, Homo sapiens
  mature of SEQ ID 628
aaatctgtaaattctgacattaa

SEQ ID NO: 2611 - DNA, 25 bp, Homo sapiens
  mature of SEQ ID 629
tctattgattatctgcttttatttg

SEQ ID NO: 2612 - DNA, 26 bp, Homo sapiens
  mature of SEQ ID 631
gctgaggtaggtgggtcagagtctgg

SEQ ID NO: 2613 - DNA, 32 bp, Homo sapiens
  mature of SEQ ID 633
aagatagaggtcatttctatgcagagaaaaac

SEQ ID NO: 2614 - DNA, 22 bp, Homo sapiens
  mature of SEQ ID 637
tgacagtttaatagtgttttgt

SEQ ID NO: 2615 - DNA, 33 bp, Homo sapiens
  mature of SEQ ID 638
ccttccaggtcattacctgcggccgcggaggca

SEQ ID NO: 2616 - DNA, 31 bp, Homo sapiens
  mature of SEQ ID 638
gcctccccttccaggtcattacctgcggccg

SEQ ID NO: 2617 - DNA, 30 bp, Homo sapiens
  mature of SEQ ID 638
tgccaccatggcctgatgagtgatctggtg

SEQ ID NO: 2618 - DNA, 32 bp, Homo sapiens
  mature of SEQ ID 638
ccatggcctgatgagtgatctggtgggcgacg

SEQ ID NO: 2619 - DNA, 28 bp, Homo sapiens
  mature of SEQ ID 639
atttaatttgcctgggataagcagttgg

SEQ ID NO: 2620 - DNA, 22 bp, Homo sapiens
  mature of SEQ ID 640
gttgccataacaataagatatc

SEQ ID NO: 2621 - DNA, 34 bp, Homo sapiens
  mature of SEQ ID 640
ataacaactttgatatttctttattatttttagc

SEQ ID NO: 2622 - DNA, 32 bp, Homo sapiens
  mature of SEQ ID 640
agttgctataacaactttgatatttctttatt

SEQ ID NO: 2623 - DNA, 27 bp, Homo sapiens
  mature of SEQ ID 641
aggggccattcacagtcttctgggtgg

SEQ ID NO: 2624 - DNA, 27 bp, Homo sapiens
  mature of SEQ ID 642
tgtaaagcagattaattttcatgcctc

SEQ ID NO: 2625 - DNA, 31 bp, Homo sapiens
  mature of SEQ ID 642
gaggagaaaagaaatgtagttacatattcat

SEQ ID NO: 2626 - DNA, 26 bp, Homo sapiens
  mature of SEQ ID 643
cttttgctgttctctgttgcatgaag

SEQ ID NO: 2627 - DNA, 29 bp, Homo sapiens
  mature of SEQ ID 643
ctttatgcttcagaaaatttaaaggtcat

SEQ ID NO: 2628 - DNA, 32 bp, Homo sapiens
  mature of SEQ ID 643
atgcttcagaaaatttaaaggtcattttcctt

SEQ ID NO: 2629 - DNA, 30 bp, Homo sapiens
  mature of SEQ ID 644
tgcatctgggacatcaattagcatgtttgt

SEQ ID NO: 2630 - DNA, 32 bp, Homo sapiens
  mature of SEQ ID 644
ctgggacatcaattagcatgtttgttgaggct

SEQ ID NO: 2631 - DNA, 29 bp, Homo sapiens
  mature of SEQ ID 645
aagtggctctgaggcatcatggagaacag

SEQ ID NO: 2632 - DNA, 22 bp, Homo sapiens
  mature of SEQ ID 646
tagttttaaaataaatattcca

SEQ ID NO: 2633 - DNA, 24 bp, Homo sapiens
  mature of SEQ ID 650
attcagtgtgtttatctgaatctg

SEQ ID NO: 2634 - DNA, 19 bp, Homo sapiens
  mature of SEQ ID 650
gatcatgccgtacatgttt

SEQ ID NO: 2635 - DNA, 31 bp, Homo sapiens
  mature of SEQ ID 650
gtgtgatgtgcaatcaatcaaataaatgcac

SEQ ID NO: 2636 - DNA, 29 bp, Homo sapiens
  mature of SEQ ID 650
gaatgtgtgatgtgcaatcaatcaaataa

SEQ ID NO: 2637 - DNA, 31 bp, Homo sapiens
  mature of SEQ ID 651
ttccagccaggccacctctcctttatctgca

SEQ ID NO: 2638 - DNA, 29 bp, Homo sapiens
  mature of SEQ ID 652
tagctgcgctggcgcaatgataccttaat

SEQ ID NO: 2639 - DNA, 31 bp, Homo sapiens
  mature of SEQ ID 652
tgcgctggcgcaatgataccttaatgataga

SEQ ID NO: 2640 - DNA, 19 bp, Homo sapiens
  mature of SEQ ID 655
tctttggaagaaagatgtt

SEQ ID NO: 2641 - DNA, 31 bp, Homo sapiens
  mature of SEQ ID 657
atttctcttaatcatagcatcattttgatcc

SEQ ID NO: 2642 - DNA, 19 bp, Homo sapiens
  mature of SEQ ID 658
gtgaagtgagtcctttaaa

SEQ ID NO: 2643 - DNA, 30 bp, Homo sapiens
  mature of SEQ ID 659
tgcagcccaaactgagatgtgatttttatg

SEQ ID NO: 2644 - DNA, 26 bp, Homo sapiens
  mature of SEQ ID 660
atctattgtatcttttttgcatggaa

SEQ ID NO: 2645 - DNA, 28 bp, Homo sapiens
  mature of SEQ ID 660
catgcagaagagaagctgcacttagatg

SEQ ID NO: 2646 - DNA, 25 bp, Homo sapiens
  mature of SEQ ID 662
atgtgtttgtcaagaggccacttag

SEQ ID NO: 2647 - DNA, 20 bp, Homo sapiens
  mature of SEQ ID 663
tctaaaaggagaatcaacca

SEQ ID NO: 2648 - DNA, 23 bp, Homo sapiens
  mature of SEQ ID 664
tggttctgcacagttaaaaatag

SEQ ID NO: 2649 - DNA, 25 bp, Homo sapiens
  mature of SEQ ID 664
ctcccacggcctgaagctgctgcca

SEQ ID NO: 2650 - DNA, 24 bp, Homo sapiens
  mature of SEQ ID 665
ttgaaaaaccatcaccatttatcc

SEQ ID NO: 2651 - DNA, 20 bp, Homo sapiens
  mature of SEQ ID 666
gggttgagtgctgacagtgt

SEQ ID NO: 2652 - DNA, 22 bp, Homo sapiens
  mature of SEQ ID 667
tcatcttcagaatttttgcatc

SEQ ID NO: 2653 - DNA, 34 bp, Homo sapiens
  mature of SEQ ID 668
atttgcatatccaattaattcttcctgttttaat

SEQ ID NO: 2654 - DNA, 31 bp, Homo sapiens
  mature of SEQ ID 668
aatctcatttgcatatccaattaattcttcc

SEQ ID NO: 2655 - DNA, 29 bp, Homo sapiens
  mature of SEQ ID 668
gttaaagcaaattggtatgtaattagatt

SEQ ID NO: 2656 - DNA, 26 bp, Homo sapiens
  mature of SEQ ID 669
gaaagctgaaggtgctggagatgcca

SEQ ID NO: 2657 - DNA, 32 bp, Homo sapiens
  mature of SEQ ID 670
tacaaaattcagtcacatttcaaaattttctg

SEQ ID NO: 2658 - DNA, 34 bp, Homo sapiens
  mature of SEQ ID 670
ttcagtcacatttcaaaattttctgctacaataa

SEQ ID NO: 2659 - DNA, 23 bp, Homo sapiens
  mature of SEQ ID 671
ctggtgggctgggacaccaggga

SEQ ID NO: 2660 - DNA, 25 bp, Homo sapiens
  mature of SEQ ID 671
tccattaggccagcaacgcttgtag

SEQ ID NO: 2661 - DNA, 27 bp, Homo sapiens
  mature of SEQ ID 672
tgattgtgcccgtctgtttgatccaat

SEQ ID NO: 2662 - DNA, 35 bp, Homo sapiens
  mature of SEQ ID 672
gggaagattgagcagaactggcattgcttgctttc

SEQ ID NO: 2663 - DNA, 33 bp, Homo sapiens
  mature of SEQ ID 672
ctcattgagggaagattgagcagaactggcatt

SEQ ID NO: 2664 - DNA, 23 bp, Homo sapiens
  mature of SEQ ID 673
ttaatgaattcactttgatgaca

SEQ ID NO: 2665 - DNA, 26 bp, Homo sapiens
  mature of SEQ ID 674
agcttgcttacattaagcagagtaat

SEQ ID NO: 2666 - DNA, 23 bp, Homo sapiens
  mature of SEQ ID 674
cccacatgcccaccaggagcaag

SEQ ID NO: 2667 - DNA, 19 bp, Homo sapiens
  mature of SEQ ID 675
caggagccagggagggagt

SEQ ID NO: 2668 - DNA, 33 bp, Homo sapiens
  mature of SEQ ID 676
ggttccagagtgcagattccagatttgttattt

SEQ ID NO: 2669 - DNA, 34 bp, Homo sapiens
  mature of SEQ ID 676
ggctaataagtatgtaattatcacatttggagcc

SEQ ID NO: 2670 - DNA, 32 bp, Homo sapiens
  mature of SEQ ID 677
aaagagtttccaagtttcccattaatgttttg

SEQ ID NO: 2671 - DNA, 29 bp, Homo sapiens
  mature of SEQ ID 677
cagaacttttttggggaacttcaaaggta

SEQ ID NO: 2672 - DNA, 31 bp, Homo sapiens
  mature of SEQ ID 677
acttttttggggaacttcaaaggtacacttt

SEQ ID NO: 2673 - DNA, 26 bp, Homo sapiens
  mature of SEQ ID 679
gtggcagatgcataactaatcttagc

SEQ ID NO: 2674 - DNA, 26 bp, Homo sapiens
  mature of SEQ ID 680
gggcaggcacggtgttccatggcaag

SEQ ID NO: 2675 - DNA, 23 bp, Homo sapiens
  mature of SEQ ID 680
ggcatgaagctgggcttgctgct

SEQ ID NO: 2676 - DNA, 24 bp, Homo sapiens
  mature of SEQ ID 681
attaaatatcaggcagaatacctc

SEQ ID NO: 2677 - DNA, 27 bp, Homo sapiens
  mature of SEQ ID 681
atatttaatgattgccatttttattcc

SEQ ID NO: 2678 - DNA, 33 bp, Homo sapiens
  mature of SEQ ID 683
cagctaaataagcatgcaaaccatgctgtgatt

SEQ ID NO: 2679 - DNA, 20 bp, Homo sapiens
  mature of SEQ ID 683
aatcacaccattcatgcatg

SEQ ID NO: 2680 - DNA, 19 bp, Homo sapiens
  mature of SEQ ID 684
taatggttgacctagttct

SEQ ID NO: 2681 - DNA, 33 bp, Homo sapiens
  mature of SEQ ID 684
gaagggtgtgcgctgcagagcagtttcctgtta

SEQ ID NO: 2682 - DNA, 33 bp, Homo sapiens
  mature of SEQ ID 685
tcgggttgtgctaatttgcacattaatatctgt

SEQ ID NO: 2683 - DNA, 30 bp, Homo sapiens
  mature of SEQ ID 685
acatttattaatatgcaaattctaagtggc

SEQ ID NO: 2684 - DNA, 32 bp, Homo sapiens
  mature of SEQ ID 685
tattaatatgcaaattctaagtggcaatctgg

SEQ ID NO: 2685 - DNA, 22 bp, Homo sapiens
  mature of SEQ ID 686
aaagaatgcagtgaccattttg

SEQ ID NO: 2686 - DNA, 26 bp, Homo sapiens
  mature of SEQ ID 687
gcactaatagatttccattgggccct

SEQ ID NO: 2687 - DNA, 31 bp, Homo sapiens
  mature of SEQ ID 688
aaaggatttatatattttttgtacaaagttt

SEQ ID NO: 2688 - DNA, 29 bp, Homo sapiens
  mature of SEQ ID 688
gaacaaaggatttatatattttttgtaca

SEQ ID NO: 2689 - DNA, 30 bp, Homo sapiens
  mature of SEQ ID 688
aaactgtataattttgtaaataatttgttt

SEQ ID NO: 2690 - DNA, 24 bp, Homo sapiens
  mature of SEQ ID 691
caatccagtgcacttagcaactga

SEQ ID NO: 2691 - DNA, 23 bp, Homo sapiens
  mature of SEQ ID 694
ttcttctatatttcaattataat

SEQ ID NO: 2692 - DNA, 21 bp, Homo sapiens
  mature of SEQ ID 696
atttcatcattcttgttacaa

SEQ ID NO: 2693 - DNA, 32 bp, Homo sapiens
  mature of SEQ ID 696
ttttttgacactttaattatgaaggaactatt

SEQ ID NO: 2694 - DNA, 34 bp, Homo sapiens
  mature of SEQ ID 698
ctaattgctaatgtttgaagtcagtttgattcct

SEQ ID NO: 2695 - DNA, 31 bp, Homo sapiens
  mature of SEQ ID 699
gtttgggcattatttcatggcagatgggcca

SEQ ID NO: 2696 - DNA, 30 bp, Homo sapiens
  mature of SEQ ID 700
tcattgggttttatagtggctttctgattt

SEQ ID NO: 2697 - DNA, 20 bp, Homo sapiens
  mature of SEQ ID 700
aagaagggagtttgaaagtt

SEQ ID NO: 2698 - DNA, 20 bp, Homo sapiens
  mature of SEQ ID 701
caccagtgctgtcctggctg

SEQ ID NO: 2699 - DNA, 24 bp, Homo sapiens
  mature of SEQ ID 702
gctgtcataaagatgatgtaaatc

SEQ ID NO: 2700 - DNA, 34 bp, Homo sapiens
  mature of SEQ ID 702
ttgcattaactgtaatgaagcaaatgacaaaatc

SEQ ID NO: 2701 - DNA, 23 bp, Homo sapiens
  mature of SEQ ID 703
actgggaggattgaattgcattt

SEQ ID NO: 2702 - DNA, 25 bp, Homo sapiens
  mature of SEQ ID 704
agcctggagaccagatgttgctttc

SEQ ID NO: 2703 - DNA, 31 bp, Homo sapiens
  mature of SEQ ID 704
tgtcacatctgtctgcaattggctacctctc

SEQ ID NO: 2704 - DNA, 29 bp, Homo sapiens
  mature of SEQ ID 704
gaaatgtcacatctgtctgcaattggcta

SEQ ID NO: 2705 - DNA, 26 bp, Homo sapiens
  mature of SEQ ID 705
cctggctttctttgtaaagccattaa

SEQ ID NO: 2706 - DNA, 21 bp, Homo sapiens
  mature of SEQ ID 706
aaactggcaattaaaaccttg

SEQ ID NO: 2707 - DNA, 31 bp, Homo sapiens
  mature of SEQ ID 707
ctgcagttcttgccacttgcaagctcttcac

SEQ ID NO: 2708 - DNA, 34 bp, Homo sapiens
  mature of SEQ ID 707
ttcttgccacttgcaagctcttcacaccacaaac

SEQ ID NO: 2709 - DNA, 26 bp, Homo sapiens
  mature of SEQ ID 708
ttttccattatggtgtcagctaattt

SEQ ID NO: 2710 - DNA, 22 bp, Homo sapiens
  mature of SEQ ID 709
ctctcccagcccagcctgagtc

SEQ ID NO: 2711 - DNA, 23 bp, Homo sapiens
  mature of SEQ ID 710
ggaaagtgttgtggggctcaagc

SEQ ID NO: 2712 - DNA, 19 bp, Homo sapiens
  mature of SEQ ID 712
aatgttaataaaggtttcg

SEQ ID NO: 2713 - DNA, 19 bp, Homo sapiens
  mature of SEQ ID 713
gggggattatgatgcttgt

SEQ ID NO: 2714 - DNA, 22 bp, Homo sapiens
  mature of SEQ ID 713
atccctctgaacagatgagatt

SEQ ID NO: 2715 - DNA, 31 bp, Homo sapiens
  mature of SEQ ID 714
accagctggtttttcacatagataaggtcaa

SEQ ID NO: 2716 - DNA, 31 bp, Homo sapiens
  mature of SEQ ID 715
gcgccacgagaagctggaccagcgccagtgc

SEQ ID NO: 2717 - DNA, 29 bp, Homo sapiens
  mature of SEQ ID 715
agaagcgccacgagaagctggaccagcgc

SEQ ID NO: 2718 - DNA, 29 bp, Homo sapiens
  mature of SEQ ID 716
attgaattgtaaccctattttgccctgat

SEQ ID NO: 2719 - DNA, 27 bp, Homo sapiens
  mature of SEQ ID 716
cacggtaggttcattagtcaataaagc

SEQ ID NO: 2720 - DNA, 34 bp, Homo sapiens
  mature of SEQ ID 718
aagaggaatagagaattcccacataaatagcagt

SEQ ID NO: 2721 - DNA, 26 bp, Homo sapiens
  mature of SEQ ID 719
ataaattacagttttcatacaatagt

SEQ ID NO: 2722 - DNA, 20 bp, Homo sapiens
  mature of SEQ ID 719
tgctattgttttgaatatgg

SEQ ID NO: 2723 - DNA, 30 bp, Homo sapiens
  mature of SEQ ID 720
tgcatctggctacagatctaaatttattgc

SEQ ID NO: 2724 - DNA, 19 bp, Homo sapiens
  mature of SEQ ID 721
ctttctttcctgctgtgtg

SEQ ID NO: 2725 - DNA, 31 bp, Homo sapiens
  mature of SEQ ID 721
caagttctttcaattttggaggcccagcacc

SEQ ID NO: 2726 - DNA, 26 bp, Homo sapiens
  mature of SEQ ID 1509
tggccgcggccctttttggcacgacc

SEQ ID NO: 2727 - DNA, 22 bp, Homo sapiens
  mature of SEQ ID 723
ctctgttcagccccagccccaa

SEQ ID NO: 2728 - DNA, 23 bp, Homo sapiens
  mature of SEQ ID 725
atcaggctggagttgttcacttt

SEQ ID NO: 2729 - DNA, 28 bp, Homo sapiens
  mature of SEQ ID 726
ttaagtgtgatgaatacatgcttgttta

SEQ ID NO: 2730 - DNA, 34 bp, Homo sapiens
  mature of SEQ ID 728
agtaattgcgggtaatttatttcttggagggcag

SEQ ID NO: 2731 - DNA, 22 bp, Homo sapiens
  mature of SEQ ID 729
gcaattatgtttcaacattaac

SEQ ID NO: 2732 - DNA, 23 bp, Homo sapiens
  mature of SEQ ID 729
agtgtttcaatttgaaattgaaa

SEQ ID NO: 2733 - DNA, 34 bp, Homo sapiens
  mature of SEQ ID 730
gcattcatttagggtcctggcagctgagctgcac

SEQ ID NO: 2734 - DNA, 21 bp, Homo sapiens
  mature of SEQ ID 731
tttctctcatcttgctttact

SEQ ID NO: 2735 - DNA, 33 bp, Homo sapiens
  mature of SEQ ID 731
caaattagtttttacacctgtaaaagagaagag

SEQ ID NO: 2736 - DNA, 19 bp, Homo sapiens
  mature of SEQ ID 732
acaacctgcttggcttcat

SEQ ID NO: 2737 - DNA, 32 bp, Homo sapiens
  mature of SEQ ID 732
gatgtaattgcaaaatgaagctgcaaatgtct

SEQ ID NO: 2738 - DNA, 25 bp, Homo sapiens
  mature of SEQ ID 733
gccaagggtctggaatccatccgtg

SEQ ID NO: 2739 - DNA, 36 bp, Homo sapiens
  mature of SEQ ID 735
ctgtagaaatatcctattaaatattgtatgtccctc

SEQ ID NO: 2740 - DNA, 34 bp, Homo sapiens
  mature of SEQ ID 735
gttattgttctgtagaaatatcctattaaatatt

SEQ ID NO: 2741 - DNA, 28 bp, Homo sapiens
  mature of SEQ ID 735
gaggtacagatttttacaaggacataat

SEQ ID NO: 2742 - DNA, 33 bp, Homo sapiens
  mature of SEQ ID 736
gaatggggcgtgctgtgataatgggggttaatg

SEQ ID NO: 2743 - DNA, 30 bp, Homo sapiens
  mature of SEQ ID 736
ttttggaatggggcgtgctgtgataatggg

SEQ ID NO: 2744 - DNA, 23 bp, Homo sapiens
  mature of SEQ ID 737
tgcttttcattaaagagataatg

SEQ ID NO: 2745 - DNA, 19 bp, Homo sapiens
  mature of SEQ ID 737
cattattcagttaatgaga

SEQ ID NO: 2746 - DNA, 22 bp, Homo sapiens
  mature of SEQ ID 738
catttctctttcataacgggcc

SEQ ID NO: 2747 - DNA, 26 bp, Homo sapiens
  mature of SEQ ID 739
ggacattgaataatgatactttcagt

SEQ ID NO: 2748 - DNA, 20 bp, Homo sapiens
  mature of SEQ ID 740
tttatgatttgatttcaggt

SEQ ID NO: 2749 - DNA, 23 bp, Homo sapiens
  mature of SEQ ID 740
cagattgaatcttaaaaggatta

SEQ ID NO: 2750 - DNA, 24 bp, Homo sapiens
  mature of SEQ ID 741
acacattctttcggagagggaggg

SEQ ID NO: 2751 - DNA, 25 bp, Homo sapiens
  mature of SEQ ID 741
gcacttacacctgaacttgtctcca

SEQ ID NO: 2752 - DNA, 26 bp, Homo sapiens
  mature of SEQ ID 743
atacccttggtcattcggatgaagtc

SEQ ID NO: 2753 - DNA, 26 bp, Homo sapiens
  mature of SEQ ID 743
cgacaggaattgccagcagcaacggc

SEQ ID NO: 2754 - DNA, 33 bp, Homo sapiens
  mature of SEQ ID 744
aatagtgcataaaatgtcaccacttcatttaac

SEQ ID NO: 2755 - DNA, 30 bp, Homo sapiens
  mature of SEQ ID 744
ggcttaatagtgcataaaatgtcaccactt

SEQ ID NO: 2756 - DNA, 21 bp, Homo sapiens
  mature of SEQ ID 744
tgtaatcatgcattatgagtc

SEQ ID NO: 2757 - DNA, 25 bp, Homo sapiens
  mature of SEQ ID 745
tcctgcatgctgttcacactgctgc

SEQ ID NO: 2758 - DNA, 25 bp, Homo sapiens
  mature of SEQ ID 746
tgggcatttgttcattaataggggg

SEQ ID NO: 2759 - DNA, 35 bp, Homo sapiens
  mature of SEQ ID 746
ctccctgtgtatgagtacagattgccctttcttgc

SEQ ID NO: 2760 - DNA, 35 bp, Homo sapiens
  mature of SEQ ID 746
atgagtacagattgccctttcttgcactgtattta

SEQ ID NO: 2761 - DNA, 26 bp, Homo sapiens
  mature of SEQ ID 746
attgccctttcttgcactgtatttag

SEQ ID NO: 2762 - DNA, 20 bp, Homo sapiens
  mature of SEQ ID 747
tcagtctgtaaagcttttga

SEQ ID NO: 2763 - DNA, 31 bp, Homo sapiens
  mature of SEQ ID 747
ttaaaagttatttatgagctgttagggatcc

SEQ ID NO: 2764 - DNA, 22 bp, Homo sapiens
  mature of SEQ ID 748
cactggtatctaaaagtagaaa

SEQ ID NO: 2765 - DNA, 26 bp, Homo sapiens
  mature of SEQ ID 748
tcagctgtctttagtttcacagtcca

SEQ ID NO: 2766 - DNA, 19 bp, Homo sapiens
  mature of SEQ ID 749
tcacttaactgtgaaaaag

SEQ ID NO: 2767 - DNA, 19 bp, Homo sapiens
  mature of SEQ ID 750
ccagaagtagccctagtaa

SEQ ID NO: 2768 - DNA, 25 bp, Homo sapiens
  mature of SEQ ID 751
gcaccactttctctcaccaattaaa

SEQ ID NO: 2769 - DNA, 27 bp, Homo sapiens
  mature of SEQ ID 752
gactggaggcagatccagttcaggccg

SEQ ID NO: 2770 - DNA, 29 bp, Homo sapiens
  mature of SEQ ID 752
gaaactggagccaattttctgtcttcatc

SEQ ID NO: 2771 - DNA, 34 bp, Homo sapiens
  mature of SEQ ID 753
gtttactgcagcttttgacttcttcaaagagctg

SEQ ID NO: 2772 - DNA, 29 bp, Homo sapiens
  mature of SEQ ID 754
gagtgatttaattcattttatgttaatta

SEQ ID NO: 2773 - DNA, 34 bp, Homo sapiens
  mature of SEQ ID 754
taattgatatgacacacttactctacatgaactt

SEQ ID NO: 2774 - DNA, 21 bp, Homo sapiens
  mature of SEQ ID 755
gcatccacaagaccaccttca

SEQ ID NO: 2775 - DNA, 19 bp, Homo sapiens
  mature of SEQ ID 756
gcagatgctccccagattt

SEQ ID NO: 2776 - DNA, 25 bp, Homo sapiens
  mature of SEQ ID 757
ctttctcagcccctgtaagtattaa

SEQ ID NO: 2777 - DNA, 22 bp, Homo sapiens
  mature of SEQ ID 759
ggtaatttgtaatgaatgaagc

SEQ ID NO: 2778 - DNA, 31 bp, Homo sapiens
  mature of SEQ ID 760
tccatatgatgaatttgtgccattttcttca

SEQ ID NO: 2779 - DNA, 25 bp, Homo sapiens
  mature of SEQ ID 760
acaaatggatgcattttatcctgga

SEQ ID NO: 2780 - DNA, 31 bp, Homo sapiens
  mature of SEQ ID 761
tcaattttataatggtaataggtgtactgaa

SEQ ID NO: 2781 - DNA, 19 bp, Homo sapiens
  mature of SEQ ID 762
ctgtcagcgtatcatctag

SEQ ID NO: 2782 - DNA, 30 bp, Homo sapiens
  mature of SEQ ID 763
cgatagcctataaagttaatgagatattac

SEQ ID NO: 2783 - DNA, 30 bp, Homo sapiens
  mature of SEQ ID 764
gaaggaaaacaagaaattcaacttttaagc

SEQ ID NO: 2784 - DNA, 32 bp, Homo sapiens
  mature of SEQ ID 764
aaaacaagaaattcaacttttaagctgggcta

SEQ ID NO: 2785 - DNA, 20 bp, Homo sapiens
  mature of SEQ ID 765
cagaaccacctggttgatgg

SEQ ID NO: 2786 - DNA, 31 bp, Homo sapiens
  mature of SEQ ID 765
cactgggtggccaaggcctggctgaatgaca

SEQ ID NO: 2787 - DNA, 29 bp, Homo sapiens
  mature of SEQ ID 765
ccatcactgggtggccaaggcctggctga

SEQ ID NO: 2788 - DNA, 19 bp, Homo sapiens
  mature of SEQ ID 766
attgggatgcagaacagta

SEQ ID NO: 2789 - DNA, 19 bp, Homo sapiens
  mature of SEQ ID 768
aaaccatgatgcctttgta

SEQ ID NO: 2790 - DNA, 19 bp, Homo sapiens
  mature of SEQ ID 768
ttgctgtttgcacccctga

SEQ ID NO: 2791 - DNA, 34 bp, Homo sapiens
  mature of SEQ ID 770
ctatgcgtcttgacggatttggggttggcagagc

SEQ ID NO: 2792 - DNA, 30 bp, Homo sapiens
  mature of SEQ ID 770
gctttctatccccattcagtccacttatag

SEQ ID NO: 2793 - DNA, 31 bp, Homo sapiens
  mature of SEQ ID 771
tcataaaattatttccatataaagtctgttt

SEQ ID NO: 2794 - DNA, 21 bp, Homo sapiens
  mature of SEQ ID 771
ttttaagataaactttaactt

SEQ ID NO: 2795 - DNA, 31 bp, Homo sapiens
  mature of SEQ ID 772
caaatgcatgcaccatgaaaaacaattagca

SEQ ID NO: 2796 - DNA, 20 bp, Homo sapiens
  mature of SEQ ID 773
ggctaattactattcactgt

SEQ ID NO: 2797 - DNA, 26 bp, Homo sapiens
  mature of SEQ ID 775
tgaatccatctgccaagagaaggtca

SEQ ID NO: 2798 - DNA, 23 bp, Homo sapiens
  mature of SEQ ID 777
atgtattgctatgtctgaatgca

SEQ ID NO: 2799 - DNA, 21 bp, Homo sapiens
  mature of SEQ ID 777
atgcactgctaaagcatatat

SEQ ID NO: 2800 - DNA, 33 bp, Homo sapiens
  mature of SEQ ID 778
caaccactggctagtgtacatatgaactaaaat

SEQ ID NO: 2801 - DNA, 27 bp, Homo sapiens
  mature of SEQ ID 778
aagttctttacaccaagtaaatggttg

SEQ ID NO: 2802 - DNA, 19 bp, Homo sapiens
  mature of SEQ ID 779
cagaactattattttaggc

SEQ ID NO: 2803 - DNA, 27 bp, Homo sapiens
  mature of SEQ ID 779
tctggccagcatggttttgattgtatg

SEQ ID NO: 2804 - DNA, 27 bp, Homo sapiens
  mature of SEQ ID 780
cctgattgtcagatttcagtaggaacc

SEQ ID NO: 2805 - DNA, 21 bp, Homo sapiens
  mature of SEQ ID 780
taatggaagctgacagtgaag

SEQ ID NO: 2806 - DNA, 20 bp, Homo sapiens
  mature of SEQ ID 781
agcaggtgtgagctgacaag

SEQ ID NO: 2807 - DNA, 29 bp, Homo sapiens
  mature of SEQ ID 781
tgtcgagaagttggcttgttatcagttag

SEQ ID NO: 2808 - DNA, 28 bp, Homo sapiens
  mature of SEQ ID 782
gatgagttttaacttttgtattgattgg

SEQ ID NO: 2809 - DNA, 29 bp, Homo sapiens
  mature of SEQ ID 784
cacccatcggttatctgtgtcgcctgaag

SEQ ID NO: 2810 - DNA, 31 bp, Homo sapiens
  mature of SEQ ID 784
gtaaggtacaggaaaaaggtgggggtattgt

SEQ ID NO: 2811 - DNA, 32 bp, Homo sapiens
  mature of SEQ ID 785
gaggctgacggggctgctggagtttgcagaga

SEQ ID NO: 2812 - DNA, 30 bp, Homo sapiens
  mature of SEQ ID 785
agcaggaggctgacggggctgctggagttt

SEQ ID NO: 2813 - DNA, 32 bp, Homo sapiens
  mature of SEQ ID 785
tttctgtatatgtttctggagtcctgagcctg

SEQ ID NO: 2814 - DNA, 25 bp, Homo sapiens
  mature of SEQ ID 786
ttggaccagtcatctggctctgcct

SEQ ID NO: 2815 - DNA, 27 bp, Homo sapiens
  mature of SEQ ID 786
gctggctgctggtgaggccaggaggcc

SEQ ID NO: 2816 - DNA, 29 bp, Homo sapiens
  mature of SEQ ID 788
gtcacaggatcccaacgcagcaaggtaaa

SEQ ID NO: 2817 - DNA, 33 bp, Homo sapiens
  mature of SEQ ID 789
ctctttatttgaaagaagatggaaagaaatcct

SEQ ID NO: 2818 - DNA, 30 bp, Homo sapiens
  mature of SEQ ID 789
aggagctctttatttgaaagaagatggaaa

SEQ ID NO: 2819 - DNA, 28 bp, Homo sapiens
  mature of SEQ ID 790
ggtgaagccctaaagactcaatctggtc

SEQ ID NO: 2820 - DNA, 34 bp, Homo sapiens
  mature of SEQ ID 792
atgtcaaaatgtacatgtgacagctgtttgggac

SEQ ID NO: 2821 - DNA, 23 bp, Homo sapiens
  mature of SEQ ID 793
tccataaaagaataataaaaagg

SEQ ID NO: 2822 - DNA, 24 bp, Homo sapiens
  mature of SEQ ID 794
ctgacagctgttagaagaagaatg

SEQ ID NO: 2823 - DNA, 19 bp, Homo sapiens
  mature of SEQ ID 794
cttctgcattcggctcagg

SEQ ID NO: 2824 - DNA, 21 bp, Homo sapiens
  mature of SEQ ID 795
cgaagtcagagctggctcagc

SEQ ID NO: 2825 - DNA, 19 bp, Homo sapiens
  mature of SEQ ID 797
gagagtaatgtgtctaatg

SEQ ID NO: 2826 - DNA, 20 bp, Homo sapiens
  mature of SEQ ID 797
attgagtttatagacacagc

SEQ ID NO: 2827 - DNA, 21 bp, Homo sapiens
  mature of SEQ ID 798
tgatcttcaggtgaaaggagg

SEQ ID NO: 2828 - DNA, 33 bp, Homo sapiens
  mature of SEQ ID 798
accttgttccacatcctgaatttcattctttcc

SEQ ID NO: 2829 - DNA, 30 bp, Homo sapiens
  mature of SEQ ID 798
aggtcaccttgttccacatcctgaatttca

SEQ ID NO: 2830 - DNA, 26 bp, Homo sapiens
  mature of SEQ ID 799
aaatagtgcagtggcttacagatggc

SEQ ID NO: 2831 - DNA, 29 bp, Homo sapiens
  mature of SEQ ID 801
ggtataatatgagctggataattttcaca

SEQ ID NO: 2832 - DNA, 31 bp, Homo sapiens
  mature of SEQ ID 801
taatatgagctggataattttcacagcattt

SEQ ID NO: 2833 - DNA, 19 bp, Homo sapiens
  mature of SEQ ID 802
ggtggcaggtattagggat

SEQ ID NO: 2834 - DNA, 20 bp, Homo sapiens
  mature of SEQ ID 803
ttgaaacgggctaactcatt

SEQ ID NO: 2835 - DNA, 23 bp, Homo sapiens
  mature of SEQ ID 804
gggtcccggaaattcagcccagg

SEQ ID NO: 2836 - DNA, 30 bp, Homo sapiens
  mature of SEQ ID 805
tgtttgtaagctattctgacagaaaagaca

SEQ ID NO: 2837 - DNA, 32 bp, Homo sapiens
  mature of SEQ ID 805
gtaagctattctgacagaaaagacaaaggtta

SEQ ID NO: 2838 - DNA, 19 bp, Homo sapiens
  mature of SEQ ID 806
ttttattcttccagctgtg

SEQ ID NO: 2839 - DNA, 23 bp, Homo sapiens
  mature of SEQ ID 806
gtcccaggtgagtaattatagct

SEQ ID NO: 2840 - DNA, 31 bp, Homo sapiens
  mature of SEQ ID 807
ggtacctgatgtgatcgggctttttcctgtc

SEQ ID NO: 2841 - DNA, 29 bp, Homo sapiens
  mature of SEQ ID 807
atttggtacctgatgtgatcgggcttttt

SEQ ID NO: 2842 - DNA, 19 bp, Homo sapiens
  mature of SEQ ID 808
tggcaaaaatggatgtgag

SEQ ID NO: 2843 - DNA, 20 bp, Homo sapiens
  mature of SEQ ID 809
cccaatcccatgggattcat

SEQ ID NO: 2844 - DNA, 20 bp, Homo sapiens
  mature of SEQ ID 809
ttttgggattggcaattcac

SEQ ID NO: 2845 - DNA, 22 bp, Homo sapiens
  mature of SEQ ID 810
taaatgtgacttgcagagccaa

SEQ ID NO: 2846 - DNA, 26 bp, Homo sapiens
  mature of SEQ ID 811
ttttcatactcaaattaattctgtca

SEQ ID NO: 2847 - DNA, 32 bp, Homo sapiens
  mature of SEQ ID 812
tctcagaggtgatttacaaaactcattaaaga

SEQ ID NO: 2848 - DNA, 30 bp, Homo sapiens
  mature of SEQ ID 813
ttagagaaagattaaattataatcagttta

SEQ ID NO: 2849 - DNA, 30 bp, Homo sapiens
  mature of SEQ ID 813
gttaagtgtattttaatttattctcattct

SEQ ID NO: 2850 - DNA, 25 bp, Homo sapiens
  mature of SEQ ID 814
agagttagagcgcatattttattaa

SEQ ID NO: 2851 - DNA, 34 bp, Homo sapiens
  mature of SEQ ID 814
atgggaatagaaaatgtattctatattttccttg

SEQ ID NO: 2852 - DNA, 31 bp, Homo sapiens
  mature of SEQ ID 814
ggatcaatgggaatagaaaatgtattctata

SEQ ID NO: 2853 - DNA, 33 bp, Homo sapiens
  mature of SEQ ID 815
gtataagaaatcaatgacaggtacatctctctt

SEQ ID NO: 2854 - DNA, 31 bp, Homo sapiens
  mature of SEQ ID 816
cggtccacagcctaactaatttaaaaatgca

SEQ ID NO: 2855 - DNA, 29 bp, Homo sapiens
  mature of SEQ ID 816
gcaacggtccacagcctaactaatttaaa

SEQ ID NO: 2856 - DNA, 19 bp, Homo sapiens
  mature of SEQ ID 817
tttaatgaaggaatgtacc

SEQ ID NO: 2857 - DNA, 22 bp, Homo sapiens
  mature of SEQ ID 818
tggctccaggccagctccctga

SEQ ID NO: 2858 - DNA, 24 bp, Homo sapiens
  mature of SEQ ID 821
cagggtcattttcacagctttaag

SEQ ID NO: 2859 - DNA, 21 bp, Homo sapiens
  mature of SEQ ID 822
atacacaaatttacagagaag

SEQ ID NO: 2860 - DNA, 29 bp, Homo sapiens
  mature of SEQ ID 823
ctgaacaaacaccttccattgtctacaga

SEQ ID NO: 2861 - DNA, 32 bp, Homo sapiens
  mature of SEQ ID 824
aggaggggaaagtcattaagaaaagtggaatc

SEQ ID NO: 2862 - DNA, 24 bp, Homo sapiens
  mature of SEQ ID 826
atagcaatactttgtgaggttaat

SEQ ID NO: 2863 - DNA, 29 bp, Homo sapiens
  mature of SEQ ID 826
agtgcagatgcaaataatcctaacaaatt

SEQ ID NO: 2864 - DNA, 32 bp, Homo sapiens
  mature of SEQ ID 826
cagatgcaaataatcctaacaaattattctat

SEQ ID NO: 2865 - DNA, 20 bp, Homo sapiens
  mature of SEQ ID 827
gtgctgggtgggtggttttt

SEQ ID NO: 2866 - DNA, 25 bp, Homo sapiens
  mature of SEQ ID 828
gtgccgcggggccgctccgaggagc

SEQ ID NO: 2867 - DNA, 33 bp, Homo sapiens
  mature of SEQ ID 829
agtgtttgcaaaattggaaaagatttaatcaaa

SEQ ID NO: 2868 - DNA, 36 bp, Homo sapiens
  mature of SEQ ID 829
caaaattggaaaagatttaatcaaaataaggtgata

SEQ ID NO: 2869 - DNA, 20 bp, Homo sapiens
  mature of SEQ ID 829
tgtgtttacagataaaatct

SEQ ID NO: 2870 - DNA, 31 bp, Homo sapiens
  mature of SEQ ID 832
catgtgatttctgcccagtgctctgaatgtc

SEQ ID NO: 2871 - DNA, 33 bp, Homo sapiens
  mature of SEQ ID 832
atttctgcccagtgctctgaatgtcaaagtgaa

SEQ ID NO: 2872 - DNA, 25 bp, Homo sapiens
  mature of SEQ ID 832
cacgggtaaacggcgggagtaacta

SEQ ID NO: 2873 - DNA, 21 bp, Homo sapiens
  mature of SEQ ID 833
gtatcatattggtatccattt

SEQ ID NO: 2874 - DNA, 33 bp, Homo sapiens
  mature of SEQ ID 834
tatgataatatgattagttacactaataatgct

SEQ ID NO: 2875 - DNA, 20 bp, Homo sapiens
  mature of SEQ ID 834
ctaattacaatattataaat

SEQ ID NO: 2876 - DNA, 29 bp, Homo sapiens
  mature of SEQ ID 835
ggcagcttagtttactaaatataacattt

SEQ ID NO: 2877 - DNA, 30 bp, Homo sapiens
  mature of SEQ ID 837
gggagaaggataaagtggaaatctaatttt

SEQ ID NO: 2878 - DNA, 33 bp, Homo sapiens
  mature of SEQ ID 837
aggattaaaggttccattattcatgctgttttc

SEQ ID NO: 2879 - DNA, 28 bp, Homo sapiens
  mature of SEQ ID 838
aggacaatatattaaatggatttttgga

SEQ ID NO: 2880 - DNA, 20 bp, Homo sapiens
  mature of SEQ ID 839
gagcctttatctcattgact

SEQ ID NO: 2881 - DNA, 29 bp, Homo sapiens
  mature of SEQ ID 840
ccaggggctttgggtttgtcacatatgcc

SEQ ID NO: 2882 - DNA, 32 bp, Homo sapiens
  mature of SEQ ID 840
gggctttgggtttgtcacatatgccactgtgg

SEQ ID NO: 2883 - DNA, 25 bp, Homo sapiens
  mature of SEQ ID 841
ttatggcagccaggatattgtcagg

SEQ ID NO: 2884 - DNA, 29 bp, Homo sapiens
  mature of SEQ ID 842
taatatagtgtacaatataaggcatccag

SEQ ID NO: 2885 - DNA, 31 bp, Homo sapiens
  mature of SEQ ID 842
atagtgtacaatataaggcatccagatgctg

SEQ ID NO: 2886 - DNA, 20 bp, Homo sapiens
  mature of SEQ ID 842
tcctgctggtgctaataaag

SEQ ID NO: 2887 - DNA, 28 bp, Homo sapiens
  mature of SEQ ID 843
tctctgggaaaaatcaaattttaatatg

SEQ ID NO: 2888 - DNA, 19 bp, Homo sapiens
  mature of SEQ ID 843
tatattaccacagtttgat

SEQ ID NO: 2889 - DNA, 25 bp, Homo sapiens
  mature of SEQ ID 847
gccccaccccgggatctggtgacgc

SEQ ID NO: 2890 - DNA, 34 bp, Homo sapiens
  mature of SEQ ID 848
tgcattcatttacatacaatttgcaagaaatgtt

SEQ ID NO: 2891 - DNA, 33 bp, Homo sapiens
  mature of SEQ ID 849
cagactcaaatattttctttgattgtcacaaaa

SEQ ID NO: 2892 - DNA, 27 bp, Homo sapiens
  mature of SEQ ID 850
aaatatgactatgcacaacaaaatcat

SEQ ID NO: 2893 - DNA, 21 bp, Homo sapiens
  mature of SEQ ID 851
tgtaattatcattagcataaa

SEQ ID NO: 2894 - DNA, 19 bp, Homo sapiens
  mature of SEQ ID 852
aaatatttttgaagataca

SEQ ID NO: 2895 - DNA, 24 bp, Homo sapiens
  mature of SEQ ID 852
tgctgaagctgctttttaaagggg

SEQ ID NO: 2896 - DNA, 32 bp, Homo sapiens
  mature of SEQ ID 854
attctattatgtgagattgaattggtttctgc

SEQ ID NO: 2897 - DNA, 34 bp, Homo sapiens
  mature of SEQ ID 854
tatgtgagattgaattggtttctgcaggtggttg

SEQ ID NO: 2898 - DNA, 27 bp, Homo sapiens
  mature of SEQ ID 856
gtctctttaatataaacaagattaatt

SEQ ID NO: 2899 - DNA, 20 bp, Homo sapiens
  mature of SEQ ID 857
tagaggaattctgactcatt

SEQ ID NO: 2900 - DNA, 28 bp, Homo sapiens
  mature of SEQ ID 858
tactgcttttgaaggttccaggtctgtg

SEQ ID NO: 2901 - DNA, 19 bp, Homo sapiens
  mature of SEQ ID 859
tgacagagaaatcctttgt

SEQ ID NO: 2902 - DNA, 26 bp, Homo sapiens
  mature of SEQ ID 859
ttttctgtgttagaagatgctatcgg

SEQ ID NO: 2903 - DNA, 24 bp, Homo sapiens
  mature of SEQ ID 860
tgttttgaataattgtttcctgtt

SEQ ID NO: 2904 - DNA, 30 bp, Homo sapiens
  mature of SEQ ID 860
agcagaacaagtaattaagatgacatttgt

SEQ ID NO: 2905 - DNA, 32 bp, Homo sapiens
  mature of SEQ ID 860
aacaagtaattaagatgacatttgtgagtact

SEQ ID NO: 2906 - DNA, 35 bp, Homo sapiens
  mature of SEQ ID 861
tctgtagttgagcaaacgtcttaaaaagtcatttg

SEQ ID NO: 2907 - DNA, 33 bp, Homo sapiens
  mature of SEQ ID 861
atttgctttctgtagttgagcaaacgtcttaaa

SEQ ID NO: 2908 - DNA, 34 bp, Homo sapiens
  mature of SEQ ID 861
taaattactttctatgatgttctatagagcaaat

SEQ ID NO: 2909 - DNA, 19 bp, Homo sapiens
  mature of SEQ ID 862
aagctgttgtcatgtaaat

SEQ ID NO: 2910 - DNA, 24 bp, Homo sapiens
  mature of SEQ ID 862
aattttgtgacatgctggtctgat

SEQ ID NO: 2911 - DNA, 26 bp, Homo sapiens
  mature of SEQ ID 863
aagtgaaattatgtcctagaaaagta

SEQ ID NO: 2912 - DNA, 30 bp, Homo sapiens
  mature of SEQ ID 863
ggttatttatagcttctttaatgaattctt

SEQ ID NO: 2913 - DNA, 19 bp, Homo sapiens
  mature of SEQ ID 864
gagagaggccgctgaatta

SEQ ID NO: 2914 - DNA, 26 bp, Homo sapiens
  mature of SEQ ID 866
actgtaaatcctcagggaacagatga

SEQ ID NO: 2915 - DNA, 19 bp, Homo sapiens
  mature of SEQ ID 867
aggagtttaatttcagcaa

SEQ ID NO: 2916 - DNA, 32 bp, Homo sapiens
  mature of SEQ ID 868
gtctctcatagtcactatggcaaccagtgtcc

SEQ ID NO: 2917 - DNA, 30 bp, Homo sapiens
  mature of SEQ ID 868
cacaggtctctcatagtcactatggcaacc

SEQ ID NO: 2918 - DNA, 31 bp, Homo sapiens
  mature of SEQ ID 868
ggacagtcaccatagcaacagtagacatgtg

SEQ ID NO: 2919 - DNA, 22 bp, Homo sapiens
  mature of SEQ ID 869
aggtgatatttaactactttga

SEQ ID NO: 2920 - DNA, 20 bp, Homo sapiens
  mature of SEQ ID 869
tgaagtttaaaggtgagttt

SEQ ID NO: 2921 - DNA, 25 bp, Homo sapiens
  mature of SEQ ID 871
gttgatagttcatatcttgatctta

SEQ ID NO: 2922 - DNA, 19 bp, Homo sapiens
  mature of SEQ ID 871
gaaagttaaacttatcacc

SEQ ID NO: 2923 - DNA, 21 bp, Homo sapiens
  mature of SEQ ID 873
caagtaattaaaagaaacgca

SEQ ID NO: 2924 - DNA, 25 bp, Homo sapiens
  mature of SEQ ID 874
ggctttcctcctctctgcaggggag

SEQ ID NO: 2925 - DNA, 29 bp, Homo sapiens
  mature of SEQ ID 874
cctcacacaagaggaggattacactggct

SEQ ID NO: 2926 - DNA, 31 bp, Homo sapiens
  mature of SEQ ID 874
acacaagaggaggattacactggctctgagc

SEQ ID NO: 2927 - DNA, 27 bp, Homo sapiens
  mature of SEQ ID 875
ccatcaattgtagccatatttaagaat

SEQ ID NO: 2928 - DNA, 26 bp, Homo sapiens
  mature of SEQ ID 876
aatagatttttcacctgtcaggcagt

SEQ ID NO: 2929 - DNA, 24 bp, Homo sapiens
  mature of SEQ ID 876
gtatgatatgggtactgattagtg

SEQ ID NO: 2930 - DNA, 19 bp, Homo sapiens
  mature of SEQ ID 877
tcaaatgagaaactaagta

SEQ ID NO: 2931 - DNA, 34 bp, Homo sapiens
  mature of SEQ ID 878
aaggcggcgcgtgcggttgggaacgcggagcgga

SEQ ID NO: 2932 - DNA, 32 bp, Homo sapiens
  mature of SEQ ID 878
gttccagaaggcggcgcgtgcggttgggaacg

SEQ ID NO: 2933 - DNA, 21 bp, Homo sapiens
  mature of SEQ ID 878
ttcgattcaacggggttccgg

SEQ ID NO: 2934 - DNA, 21 bp, Homo sapiens
  mature of SEQ ID 879
atctatatttgatttaaattg

SEQ ID NO: 2935 - DNA, 20 bp, Homo sapiens
  mature of SEQ ID 881
ctggcaatagtgtccttcag

SEQ ID NO: 2936 - DNA, 19 bp, Homo sapiens
  mature of SEQ ID 881
atttcttcattccagaagg

SEQ ID NO: 2937 - DNA, 22 bp, Homo sapiens
  mature of SEQ ID 883
cttggtacttagtttgcattta

SEQ ID NO: 2938 - DNA, 31 bp, Homo sapiens
  mature of SEQ ID 884
tatgctattgcaccctgtgatgagagtggca

SEQ ID NO: 2939 - DNA, 22 bp, Homo sapiens
  mature of SEQ ID 885
tttcatcttgtcacttattacc

SEQ ID NO: 2940 - DNA, 27 bp, Homo sapiens
  mature of SEQ ID 886
gcactgcagctggctggtgggagggct

SEQ ID NO: 2941 - DNA, 23 bp, Homo sapiens
  mature of SEQ ID 887
agcattgttcagttgctatggta

SEQ ID NO: 2942 - DNA, 21 bp, Homo sapiens
  mature of SEQ ID 888
actttcccatggcctattcca

SEQ ID NO: 2943 - DNA, 33 bp, Homo sapiens
  mature of SEQ ID 889
ttccctttggctttaaggtttatttagaattca

SEQ ID NO: 2944 - DNA, 23 bp, Homo sapiens
  mature of SEQ ID 890
acaggtatttttcagagttggaa

SEQ ID NO: 2945 - DNA, 31 bp, Homo sapiens
  mature of SEQ ID 891
tccaaaaataacaattttaatttccaaatcg

SEQ ID NO: 2946 - DNA, 34 bp, Homo sapiens
  mature of SEQ ID 891
tgatttctaaatggaccaagttatttttgtgaac

SEQ ID NO: 2947 - DNA, 28 bp, Homo sapiens
  mature of SEQ ID 892
atgaaacctgacactaactgagaaaaat

SEQ ID NO: 2948 - DNA, 29 bp, Homo sapiens
  mature of SEQ ID 894
acataatgctaccaccttgctcttagctt

SEQ ID NO: 2949 - DNA, 33 bp, Homo sapiens
  mature of SEQ ID 895
ctggcatttgtcagatcacatgttccaattttt

SEQ ID NO: 2950 - DNA, 27 bp, Homo sapiens
  mature of SEQ ID 897
tctgttgagaattaaaaatgtgttggc

SEQ ID NO: 2951 - DNA, 23 bp, Homo sapiens
  mature of SEQ ID 897
cagaaagataaatctgtaccttg

SEQ ID NO: 2952 - DNA, 25 bp, Homo sapiens
  mature of SEQ ID 898
taatagcatttgagttccattaggt

SEQ ID NO: 2953 - DNA, 24 bp, Homo sapiens
  mature of SEQ ID 899
gacattttggggattccgccatat

SEQ ID NO: 2954 - DNA, 29 bp, Homo sapiens
  mature of SEQ ID 900
agtttaaccccacaactttcctctttgct

SEQ ID NO: 2955 - DNA, 32 bp, Homo sapiens
  mature of SEQ ID 900
taaccccacaactttcctctttgctagaactg

SEQ ID NO: 2956 - DNA, 30 bp, Homo sapiens
  mature of SEQ ID 902
tttgcagaatcctgcagggaatcaaggaac

SEQ ID NO: 2957 - DNA, 19 bp, Homo sapiens
  mature of SEQ ID 902
tttctctgcagggcctgca

SEQ ID NO: 2958 - DNA, 35 bp, Homo sapiens
  mature of SEQ ID 903
tctgcccttggatacacacaacaaaacccccattg

SEQ ID NO: 2959 - DNA, 32 bp, Homo sapiens
  mature of SEQ ID 903
gctggattctgcccttggatacacacaacaaa

SEQ ID NO: 2960 - DNA, 32 bp, Homo sapiens
  mature of SEQ ID 903
caatggaaattgtgcatgcatatccaggggca

SEQ ID NO: 2961 - DNA, 34 bp, Homo sapiens
  mature of SEQ ID 903
aattgtgcatgcatatccaggggcagaatttggc

SEQ ID NO: 2962 - DNA, 25 bp, Homo sapiens
  mature of SEQ ID 904
tggctctaagccatctgattttact

SEQ ID NO: 2963 - DNA, 20 bp, Homo sapiens
  mature of SEQ ID 904
atgcattatatatgagattc

SEQ ID NO: 2964 - DNA, 29 bp, Homo sapiens
  mature of SEQ ID 906
taggtgtggttgcagttggagaggatccc

SEQ ID NO: 2965 - DNA, 19 bp, Homo sapiens
  mature of SEQ ID 907
ttgccttcattatgaaaag

SEQ ID NO: 2966 - DNA, 29 bp, Homo sapiens
  mature of SEQ ID 909
tagtgctaaactcatttgcacaactacag

SEQ ID NO: 2967 - DNA, 32 bp, Homo sapiens
  mature of SEQ ID 909
gctaaactcatttgcacaactacagttaattg

SEQ ID NO: 2968 - DNA, 32 bp, Homo sapiens
  mature of SEQ ID 909
caattaattaatgtgttggaaatttggcactg

SEQ ID NO: 2969 - DNA, 32 bp, Homo sapiens
  mature of SEQ ID 910
attagcatctgtgacactaatggtgtctcatt

SEQ ID NO: 2970 - DNA, 19 bp, Homo sapiens
  mature of SEQ ID 910
aagaatgccacttcagtca

SEQ ID NO: 2971 - DNA, 31 bp, Homo sapiens
  mature of SEQ ID 911
taggacacatggtctacttcttctcaatatc

SEQ ID NO: 2972 - DNA, 29 bp, Homo sapiens
  mature of SEQ ID 911
gacgtaggacacatggtctacttcttctc

SEQ ID NO: 2973 - DNA, 29 bp, Homo sapiens
  mature of SEQ ID 911
ggtatttgaagatgcggttgaccatggtg

SEQ ID NO: 2974 - DNA, 32 bp, Homo sapiens
  mature of SEQ ID 911
tttgaagatgcggttgaccatggtgtgtacgc

SEQ ID NO: 2975 - DNA, 24 bp, Homo sapiens
  mature of SEQ ID 912
aatgacatctattaccacattaga

SEQ ID NO: 2976 - DNA, 25 bp, Homo sapiens
  mature of SEQ ID 913
tgcaataaagtaattggttaaaata

SEQ ID NO: 2977 - DNA, 33 bp, Homo sapiens
  mature of SEQ ID 914
gtaactgatatgccaatcagataaatattgtgt

SEQ ID NO: 2978 - DNA, 31 bp, Homo sapiens
  mature of SEQ ID 915
acatgatttcatgtgatgtttccccaggtac

SEQ ID NO: 2979 - DNA, 23 bp, Homo sapiens
  mature of SEQ ID 916
gctccacgtgagattctgcaaag

SEQ ID NO: 2980 - DNA, 22 bp, Homo sapiens
  mature of SEQ ID 916
tgcagcctcttaggcagagagc

SEQ ID NO: 2981 - DNA, 33 bp, Homo sapiens
  mature of SEQ ID 917
ttttgttttataaatatagtgactggatttgct

SEQ ID NO: 2982 - DNA, 20 bp, Homo sapiens
  mature of SEQ ID 917
agcagaaaattcattgctta

SEQ ID NO: 2983 - DNA, 35 bp, Homo sapiens
  mature of SEQ ID 918
tatggaggcaccaaagtagttctagatgacaagga

SEQ ID NO: 2984 - DNA, 33 bp, Homo sapiens
  mature of SEQ ID 918
tcccagaatatggaggcaccaaagtagttctag

SEQ ID NO: 2985 - DNA, 30 bp, Homo sapiens
  mature of SEQ ID 919
gaacctatagtatagaaatattatctattt

SEQ ID NO: 2986 - DNA, 33 bp, Homo sapiens
  mature of SEQ ID 919
tttaatatttttcactgggaggtttgaagctta

SEQ ID NO: 2987 - DNA, 30 bp, Homo sapiens
  mature of SEQ ID 919
gaatatttaatatttttcactgggaggttt

SEQ ID NO: 2988 - DNA, 26 bp, Homo sapiens
  mature of SEQ ID 920
atgcctgctgatcaccatcattcctt

SEQ ID NO: 2989 - DNA, 24 bp, Homo sapiens
  mature of SEQ ID 921
aggaaaattgactctggagaagga

SEQ ID NO: 2990 - DNA, 27 bp, Homo sapiens
  mature of SEQ ID 921
tgaggaaatatagatatttattgacat

SEQ ID NO: 2991 - DNA, 31 bp, Homo sapiens
  mature of SEQ ID 922
cagcagccagtgctacactttatgcattgct

SEQ ID NO: 2992 - DNA, 29 bp, Homo sapiens
  mature of SEQ ID 922
atgacagcagccagtgctacactttatgc

SEQ ID NO: 2993 - DNA, 33 bp, Homo sapiens
  mature of SEQ ID 922
atgtatgcaatgcactgtgctgtaaagccatgc

SEQ ID NO: 2994 - DNA, 30 bp, Homo sapiens
  mature of SEQ ID 922
agcagatgtatgcaatgcactgtgctgtaa

SEQ ID NO: 2995 - DNA, 23 bp, Homo sapiens
  mature of SEQ ID 923
ggaagagacggtagtttagaaaa

SEQ ID NO: 2996 - DNA, 26 bp, Homo sapiens
  mature of SEQ ID 924
attgcaattactgcactttttcaggt

SEQ ID NO: 2997 - DNA, 23 bp, Homo sapiens
  mature of SEQ ID 924
gagctgaatggttagttagcagt

SEQ ID NO: 2998 - DNA, 29 bp, Homo sapiens
  mature of SEQ ID 925
acatacttgccttcagtggtaaaggatgg

SEQ ID NO: 2999 - DNA, 21 bp, Homo sapiens
  mature of SEQ ID 926
aggaggaggaggcagggccga

SEQ ID NO: 3000 - DNA, 32 bp, Homo sapiens
  mature of SEQ ID 927
tctctaaaaggtttctaaatgatgttgatgtt

SEQ ID NO: 3001 - DNA, 22 bp, Homo sapiens
  mature of SEQ ID 927
ccatttaacagccttttaaaga

SEQ ID NO: 3002 - DNA, 24 bp, Homo sapiens
  mature of SEQ ID 928
ctgtttatttggtttctcattaac

SEQ ID NO: 3003 - DNA, 19 bp, Homo sapiens
  mature of SEQ ID 930
caaccatgtaagggagagt

SEQ ID NO: 3004 - DNA, 19 bp, Homo sapiens
  mature of SEQ ID 1184
gtggttccaaagttttaca

SEQ ID NO: 3005 - DNA, 26 bp, Homo sapiens
  mature of SEQ ID 932
ggtttttggaagctggcatggactag

SEQ ID NO: 3006 - DNA, 25 bp, Homo sapiens
  mature of SEQ ID 934
ttgggaaaggaaaactaataaagag

SEQ ID NO: 3007 - DNA, 30 bp, Homo sapiens
  mature of SEQ ID 935
cattctttttatttcctgcactctggatct

SEQ ID NO: 3008 - DNA, 32 bp, Homo sapiens
  mature of SEQ ID 935
tttttatttcctgcactctggatctattcaaa

SEQ ID NO: 3009 - DNA, 28 bp, Homo sapiens
  mature of SEQ ID 935
gagggattcagtgcagaactaaaatatg

SEQ ID NO: 3010 - DNA, 32 bp, Homo sapiens
  mature of SEQ ID 936
caaatacaaattagttgcttaaattcaggata

SEQ ID NO: 3011 - DNA, 21 bp, Homo sapiens
  mature of SEQ ID 936
tgtcctgattttatgcaactg

SEQ ID NO: 3012 - DNA, 21 bp, Homo sapiens
  mature of SEQ ID 937
gtaatcaattcattgtcatca

SEQ ID NO: 3013 - DNA, 21 bp, Homo sapiens
  mature of SEQ ID 938
ggtaatcaaggttaattctcg

SEQ ID NO: 3014 - DNA, 23 bp, Homo sapiens
  mature of SEQ ID 939
gcaaagttgataggtaggagttt

SEQ ID NO: 3015 - DNA, 34 bp, Homo sapiens
  mature of SEQ ID 940
taatgaggggaaaaattctccagctggggctgag

SEQ ID NO: 3016 - DNA, 28 bp, Homo sapiens
  mature of SEQ ID 941
ctgtatatatgtgtatagacattaacat

SEQ ID NO: 3017 - DNA, 30 bp, Homo sapiens
  mature of SEQ ID 942
cataaatacattgtaatgtcccatgtaatt

SEQ ID NO: 3018 - DNA, 32 bp, Homo sapiens
  mature of SEQ ID 942
atacattgtaatgtcccatgtaattacatggt

SEQ ID NO: 3019 - DNA, 33 bp, Homo sapiens
  mature of SEQ ID 942
gtactctgtaattactgtacattgtaacaaatg

SEQ ID NO: 3020 - DNA, 19 bp, Homo sapiens
  mature of SEQ ID 943
agtcttttattgattgtgg

SEQ ID NO: 3021 - DNA, 27 bp, Homo sapiens
  mature of SEQ ID 944
gcacattataaactctaattcattaac

SEQ ID NO: 3022 - DNA, 28 bp, Homo sapiens
  mature of SEQ ID 945
ctgcttgctgggccatgtgattcagcat

SEQ ID NO: 3023 - DNA, 20 bp, Homo sapiens
  mature of SEQ ID 946
aatacataaatgaacgggta

SEQ ID NO: 3024 - DNA, 24 bp, Homo sapiens
  mature of SEQ ID 946
aaagagccacctcatattcatagg

SEQ ID NO: 3025 - DNA, 33 bp, Homo sapiens
  mature of SEQ ID 947
gcagagagagaggggagaaaacagggagataca

SEQ ID NO: 3026 - DNA, 31 bp, Homo sapiens
  mature of SEQ ID 947
ggaggggcagagagagaggggagaaaacagg

SEQ ID NO: 3027 - DNA, 29 bp, Homo sapiens
  mature of SEQ ID 947
tcattgttattccaaaagtctctgtctag

SEQ ID NO: 3028 - DNA, 23 bp, Homo sapiens
  mature of SEQ ID 949
cttgagcaggaagagtttatttt

SEQ ID NO: 3029 - DNA, 23 bp, Homo sapiens
  mature of SEQ ID 951
gagtgacaaatttggtacttaaa

SEQ ID NO: 3030 - DNA, 19 bp, Homo sapiens
  mature of SEQ ID 951
gttaaaaacaaccctgtca

SEQ ID NO: 3031 - DNA, 31 bp, Homo sapiens
  mature of SEQ ID 952
gaatgacaaggcaggataataggctgtggtc

SEQ ID NO: 3032 - DNA, 19 bp, Homo sapiens
  mature of SEQ ID 952
cctctgcctctgtcaagtg

SEQ ID NO: 3033 - DNA, 25 bp, Homo sapiens
  mature of SEQ ID 953
acattgcactgtatgaatctggaat

SEQ ID NO: 3034 - DNA, 22 bp, Homo sapiens
  mature of SEQ ID 953
attcttggattcatacagtgat

SEQ ID NO: 3035 - DNA, 36 bp, Homo sapiens
  mature of SEQ ID 954
atctgcaatctttccctttgtaccatcacccagtga

SEQ ID NO: 3036 - DNA, 33 bp, Homo sapiens
  mature of SEQ ID 954
ctaattagatctgcaatctttccctttgtacca

SEQ ID NO: 3037 - DNA, 30 bp, Homo sapiens
  mature of SEQ ID 954
tcagggtgattgggatgcagataggattag

SEQ ID NO: 3038 - DNA, 30 bp, Homo sapiens
  mature of SEQ ID 955
gggatttatttaattcagtctcacagcctg

SEQ ID NO: 3039 - DNA, 24 bp, Homo sapiens
  mature of SEQ ID 955
caggctgacaactgatatcacaag

SEQ ID NO: 3040 - DNA, 27 bp, Homo sapiens
  mature of SEQ ID 957
aaaccaaggtggctatggcggttccag

SEQ ID NO: 3041 - DNA, 24 bp, Homo sapiens
  mature of SEQ ID 958
tgtgtttagatgccatcaagctaa

SEQ ID NO: 3042 - DNA, 24 bp, Homo sapiens
  mature of SEQ ID 959
tgttagatgtaaactagtgtagcc

SEQ ID NO: 3043 - DNA, 25 bp, Homo sapiens
  mature of SEQ ID 960
tgtcatagtactgaagattcttctt

SEQ ID NO: 3044 - DNA, 27 bp, Homo sapiens
  mature of SEQ ID 961
tattagttttagtaaatgccctgcagt

SEQ ID NO: 3045 - DNA, 24 bp, Homo sapiens
  mature of SEQ ID 961
tgtgaaaagttaactaagataata

SEQ ID NO: 3046 - DNA, 26 bp, Homo sapiens
  mature of SEQ ID 962
aaacgatccatatgttttacatttca

SEQ ID NO: 3047 - DNA, 25 bp, Homo sapiens
  mature of SEQ ID 962
ctgaaatgccaatattttgtgttgt

SEQ ID NO: 3048 - DNA, 33 bp, Homo sapiens
  mature of SEQ ID 963
cagttcccatagcaactgggctgtagcagccag

SEQ ID NO: 3049 - DNA, 31 bp, Homo sapiens
  mature of SEQ ID 963
ccctcccagttcccatagcaactgggctgta

SEQ ID NO: 3050 - DNA, 21 bp, Homo sapiens
  mature of SEQ ID 963
actgaggtggggaaaggaggg

SEQ ID NO: 3051 - DNA, 26 bp, Homo sapiens
  mature of SEQ ID 965
tgacaagtttgtgttatgatgttggc

SEQ ID NO: 3052 - DNA, 19 bp, Homo sapiens
  mature of SEQ ID 967
aaattaaaatccaatacac

SEQ ID NO: 3053 - DNA, 31 bp, Homo sapiens
  mature of SEQ ID 967
agtgcaatttgtgtataacattttagtactt

SEQ ID NO: 3054 - DNA, 34 bp, Homo sapiens
  mature of SEQ ID 967
atttgtgtataacattttagtacttaaatcaact

SEQ ID NO: 3055 - DNA, 20 bp, Homo sapiens
  mature of SEQ ID 968
ttgttcaagtgttcaggcat

SEQ ID NO: 3056 - DNA, 27 bp, Homo sapiens
  mature of SEQ ID 969
taggatatgcttcttattctggattag

SEQ ID NO: 3057 - DNA, 34 bp, Homo sapiens
  mature of SEQ ID 970
tctgctaattcagtattgatcttgatactaagat

SEQ ID NO: 3058 - DNA, 21 bp, Homo sapiens
  mature of SEQ ID 971
agccagttattcatttattct

SEQ ID NO: 3059 - DNA, 20 bp, Homo sapiens
  mature of SEQ ID 972
gcctttcctgttgagtaggt

SEQ ID NO: 3060 - DNA, 24 bp, Homo sapiens
  mature of SEQ ID 973
gtgcattaatgctataattatctg

SEQ ID NO: 3061 - DNA, 36 bp, Homo sapiens
  mature of SEQ ID 975
gggaaaatgaaaaccagaaaattaattaatctctaa

SEQ ID NO: 3062 - DNA, 34 bp, Homo sapiens
  mature of SEQ ID 975
tgattgccagggaaaatgaaaaccagaaaattaa

SEQ ID NO: 3063 - DNA, 24 bp, Homo sapiens
  mature of SEQ ID 976
gatctggcatggaataacatcaaa

SEQ ID NO: 3064 - DNA, 31 bp, Homo sapiens
  mature of SEQ ID 977
gcagagagtggcatgcaaacatttcgacaaa

SEQ ID NO: 3065 - DNA, 34 bp, Homo sapiens
  mature of SEQ ID 977
agtggcatgcaaacatttcgacaaaggccccagc

SEQ ID NO: 3066 - DNA, 26 bp, Homo sapiens
  mature of SEQ ID 977
ggtcatgtcgaggttccacaccctgc

SEQ ID NO: 3067 - DNA, 32 bp, Homo sapiens
  mature of SEQ ID 978
atctttgggtgaggtccaaccagagagggagc

SEQ ID NO: 3068 - DNA, 29 bp, Homo sapiens
  mature of SEQ ID 979
aaatgtgaaaaagtaattatggggtatgg

SEQ ID NO: 3069 - DNA, 31 bp, Homo sapiens
  mature of SEQ ID 979
gtgaaaaagtaattatggggtatgggagcca

SEQ ID NO: 3070 - DNA, 29 bp, Homo sapiens
  mature of SEQ ID 979
accacaagcccaaccatgtgttactatat

SEQ ID NO: 3071 - DNA, 31 bp, Homo sapiens
  mature of SEQ ID 980
tttaagactccttttcaagggcatttgtctt

SEQ ID NO: 3072 - DNA, 24 bp, Homo sapiens
  mature of SEQ ID 981
agaattcttcacaatcctccctaa

SEQ ID NO: 3073 - DNA, 24 bp, Homo sapiens
  mature of SEQ ID 984
tgtttagaagcaacatctaaaaac

SEQ ID NO: 3074 - DNA, 32 bp, Homo sapiens
  mature of SEQ ID 984
tctctgtgtgacttgatataaattgtgttaat

SEQ ID NO: 3075 - DNA, 29 bp, Homo sapiens
  mature of SEQ ID 986
tttggcccagggacctataatcagctcct

SEQ ID NO: 3076 - DNA, 31 bp, Homo sapiens
  mature of SEQ ID 986
gcccagggacctataatcagctcctgcccct

SEQ ID NO: 3077 - DNA, 24 bp, Homo sapiens
  mature of SEQ ID 987
tataaatctcattaatagatgtaa

SEQ ID NO: 3078 - DNA, 19 bp, Homo sapiens
  mature of SEQ ID 987
tcactattgatggagttag

SEQ ID NO: 3079 - DNA, 30 bp, Homo sapiens
  mature of SEQ ID 988
gctggaaattagtgtctagaaccaaaatgt

SEQ ID NO: 3080 - DNA, 21 bp, Homo sapiens
  mature of SEQ ID 990
ctaatttacttgctctcacta

SEQ ID NO: 3081 - DNA, 19 bp, Homo sapiens
  mature of SEQ ID 991
tgacattgatgttactgtc

SEQ ID NO: 3082 - DNA, 31 bp, Homo sapiens
  mature of SEQ ID 992
catgccctaattagccccagcatctgttccc

SEQ ID NO: 3083 - DNA, 22 bp, Homo sapiens
  mature of SEQ ID 993
agtaaagtagaataaatgagcc

SEQ ID NO: 3084 - DNA, 20 bp, Homo sapiens
  mature of SEQ ID 993
ggcttaaatttattaattga

SEQ ID NO: 3085 - DNA, 19 bp, Homo sapiens
  mature of SEQ ID 994
ctgttccacctctctgggg

SEQ ID NO: 3086 - DNA, 20 bp, Homo sapiens
  mature of SEQ ID 994
aattcattttctgtctctcc

SEQ ID NO: 3087 - DNA, 31 bp, Homo sapiens
  mature of SEQ ID 995
agaaataaaacaaatataaattatgcatttt

SEQ ID NO: 3088 - DNA, 20 bp, Homo sapiens
  mature of SEQ ID 996
ccggtttaaatcaatccaga

SEQ ID NO: 3089 - DNA, 20 bp, Homo sapiens
  mature of SEQ ID 996
ttgcaatggatttgtgctaa

SEQ ID NO: 3090 - DNA, 26 bp, Homo sapiens
  mature of SEQ ID 996
cataattaagccaagttgaaatgtaa

SEQ ID NO: 3091 - DNA, 29 bp, Homo sapiens
  mature of SEQ ID 997
ggcttgcagaatgtggatgtcttcgcggg

SEQ ID NO: 3092 - DNA, 31 bp, Homo sapiens
  mature of SEQ ID 997
tgcagaatgtggatgtcttcgcgggggaggt

SEQ ID NO: 3093 - DNA, 24 bp, Homo sapiens
  mature of SEQ ID 999
aaataaagtttattccagcaatct

SEQ ID NO: 3094 - DNA, 30 bp, Homo sapiens
  mature of SEQ ID 1000
tcattaattctcttgaaattttcatttgag

SEQ ID NO: 3095 - DNA, 24 bp, Homo sapiens
  mature of SEQ ID 1000
ctcaaatatgaatttcattaagga

SEQ ID NO: 3096 - DNA, 23 bp, Homo sapiens
  mature of SEQ ID 1002
atcctaatctgaattgttgagct

SEQ ID NO: 3097 - DNA, 22 bp, Homo sapiens
  mature of SEQ ID 1004
tcttgttcccccagtagcctct

SEQ ID NO: 3098 - DNA, 33 bp, Homo sapiens
  mature of SEQ ID 1005
ccataaaagatgcatgattagaaagttaaggat

SEQ ID NO: 3099 - DNA, 19 bp, Homo sapiens
  mature of SEQ ID 1005
agacccttggcacgtaatt

SEQ ID NO: 3100 - DNA, 31 bp, Homo sapiens
  mature of SEQ ID 1006
aaaattcataaagtatatcattaggactcct

SEQ ID NO: 3101 - DNA, 32 bp, Homo sapiens
  mature of SEQ ID 1007
agaattaactgctggacccagaggctgaaggc

SEQ ID NO: 3102 - DNA, 35 bp, Homo sapiens
  mature of SEQ ID 1007
actgctggacccagaggctgaaggcacgttgaagg

SEQ ID NO: 3103 - DNA, 35 bp, Homo sapiens
  mature of SEQ ID 1007
ttcttgagcccttggtttgaaaagctagtgatttt

SEQ ID NO: 3104 - DNA, 32 bp, Homo sapiens
  mature of SEQ ID 1007
ccttcatttcttgagcccttggtttgaaaagc

SEQ ID NO: 3105 - DNA, 34 bp, Homo sapiens
  mature of SEQ ID 1008
acagcagccctctatacttcggtacatctttggc

SEQ ID NO: 3106 - DNA, 19 bp, Homo sapiens
  mature of SEQ ID 1009
aatataattaacagtgctc

SEQ ID NO: 3107 - DNA, 28 bp, Homo sapiens
  mature of SEQ ID 1009
ttatgtagaccatcacactttaattact

SEQ ID NO: 3108 - DNA, 31 bp, Homo sapiens
  mature of SEQ ID 1011
tgtcatttgtccattttctcttctgacccag

SEQ ID NO: 3109 - DNA, 25 bp, Homo sapiens
  mature of SEQ ID 1012
aaatcgtctgctgttttagattatc

SEQ ID NO: 3110 - DNA, 27 bp, Homo sapiens
  mature of SEQ ID 1013
ctttgtaaactgagcacttttcaaaga

SEQ ID NO: 3111 - DNA, 22 bp, Homo sapiens
  mature of SEQ ID 1013
gtgagctttgatctttgcagag

SEQ ID NO: 3112 - DNA, 34 bp, Homo sapiens
  mature of SEQ ID 1015
tatcccctcctgtgttattgttgttgtaccacat

SEQ ID NO: 3113 - DNA, 31 bp, Homo sapiens
  mature of SEQ ID 1015
taactttatcccctcctgtgttattgttgtt

SEQ ID NO: 3114 - DNA, 30 bp, Homo sapiens
  mature of SEQ ID 1018
ctgggcacctgtccaaaatgaacctctaag

SEQ ID NO: 3115 - DNA, 33 bp, Homo sapiens
  mature of SEQ ID 1018
cacctgtccaaaatgaacctctaagtcttttga

SEQ ID NO: 3116 - DNA, 21 bp, Homo sapiens
  mature of SEQ ID 1018
tcagaagttatggaaggtttt

SEQ ID NO: 3117 - DNA, 25 bp, Homo sapiens
  mature of SEQ ID 1019
tgaggaaaattggagataatttatg

SEQ ID NO: 3118 - DNA, 31 bp, Homo sapiens
  mature of SEQ ID 1020
ttgctgaaactatatgatggaatttgtctgg

SEQ ID NO: 3119 - DNA, 33 bp, Homo sapiens
  mature of SEQ ID 1020
aaactatatgatggaatttgtctggtgacattt

SEQ ID NO: 3120 - DNA, 34 bp, Homo sapiens
  mature of SEQ ID 1023
gtggactctagagggtttgcattaagctttgcag

SEQ ID NO: 3121 - DNA, 20 bp, Homo sapiens
  mature of SEQ ID 1024
tatgctcattaacatgctgt

SEQ ID NO: 3122 - DNA, 19 bp, Homo sapiens
  mature of SEQ ID 1025
attctgaaggtagaggtca

SEQ ID NO: 3123 - DNA, 22 bp, Homo sapiens
  mature of SEQ ID 1026
tgggacaatgtaatatctgtct

SEQ ID NO: 3124 - DNA, 34 bp, Homo sapiens
  mature of SEQ ID 1028
ttcaaatgtaattacttttaatatatgcttgtgg

SEQ ID NO: 3125 - DNA, 31 bp, Homo sapiens
  mature of SEQ ID 1028
tattttttcaaatgtaattacttttaatata

SEQ ID NO: 3126 - DNA, 35 bp, Homo sapiens
  mature of SEQ ID 1028
aaactgagtatgtattgtagaaatgtagaggaaaa

SEQ ID NO: 3127 - DNA, 32 bp, Homo sapiens
  mature of SEQ ID 1028
ccacagaaaactgagtatgtattgtagaaatg

SEQ ID NO: 3128 - DNA, 25 bp, Homo sapiens
  mature of SEQ ID 1029
acttttctccactgtgctgctacca

SEQ ID NO: 3129 - DNA, 21 bp, Homo sapiens
  mature of SEQ ID 1030
tcaaaatgaaataatttatga

SEQ ID NO: 3130 - DNA, 25 bp, Homo sapiens
  mature of SEQ ID 1030
ggcacacttgaagtgaattgctcac

SEQ ID NO: 3131 - DNA, 32 bp, Homo sapiens
  mature of SEQ ID 1031
tttaacctgcttaaattggattttttaaagtg

SEQ ID NO: 3132 - DNA, 29 bp, Homo sapiens
  mature of SEQ ID 1031
aatttttaacctgcttaaattggattttt

SEQ ID NO: 3133 - DNA, 33 bp, Homo sapiens
  mature of SEQ ID 1032
gccctaaaacttttcccttgttcttcagctgtg

SEQ ID NO: 3134 - DNA, 31 bp, Homo sapiens
  mature of SEQ ID 1032
acagtcgccctaaaacttttcccttgttctt

SEQ ID NO: 3135 - DNA, 29 bp, Homo sapiens
  mature of SEQ ID 1033
aaattacttagcaattaaaccttcagcaa

SEQ ID NO: 3136 - DNA, 31 bp, Homo sapiens
  mature of SEQ ID 1034
tctctttctttttaatttgcttatttgtcag

SEQ ID NO: 3137 - DNA, 29 bp, Homo sapiens
  mature of SEQ ID 1034
ctgctctctttctttttaatttgcttatt

SEQ ID NO: 3138 - DNA, 31 bp, Homo sapiens
  mature of SEQ ID 1034
ctgacagtaaagtaatttaattgcactgttg

SEQ ID NO: 3139 - DNA, 22 bp, Homo sapiens
  mature of SEQ ID 1035
ttgaaagggttataaatggttt

SEQ ID NO: 3140 - DNA, 23 bp, Homo sapiens
  mature of SEQ ID 1036
gaatatgtaggtcattggatttt

SEQ ID NO: 3141 - DNA, 20 bp, Homo sapiens
  mature of SEQ ID 1038
gtgatgcctacttgggtcag

SEQ ID NO: 3142 - DNA, 23 bp, Homo sapiens
  mature of SEQ ID 1039
gggaatctattctccccatttcc

SEQ ID NO: 3143 - DNA, 19 bp, Homo sapiens
  mature of SEQ ID 1041
tgtgacagagctcagagga

SEQ ID NO: 3144 - DNA, 32 bp, Homo sapiens
  mature of SEQ ID 1041
tcctattttgagctgtgatattttaatctcca

SEQ ID NO: 3145 - DNA, 35 bp, Homo sapiens
  mature of SEQ ID 1041
ttgagctgtgatattttaatctccattcttgctgc

SEQ ID NO: 3146 - DNA, 34 bp, Homo sapiens
  mature of SEQ ID 1043
attttaacaggtgcacacttgtgtgtaagtggga

SEQ ID NO: 3147 - DNA, 32 bp, Homo sapiens
  mature of SEQ ID 1043
atgacctattttaacaggtgcacacttgtgtg

SEQ ID NO: 3148 - DNA, 23 bp, Homo sapiens
  mature of SEQ ID 1044
gataattacaaaaattatcactt

SEQ ID NO: 3149 - DNA, 20 bp, Homo sapiens
  mature of SEQ ID 1045
gggaagggtggggtttccat

SEQ ID NO: 3150 - DNA, 25 bp, Homo sapiens
  mature of SEQ ID 1046
ggggcttgccaagaccccagatgcc

SEQ ID NO: 3151 - DNA, 24 bp, Homo sapiens
  mature of SEQ ID 1047
ttttagtcattatattagcatctc

SEQ ID NO: 3152 - DNA, 30 bp, Homo sapiens
  mature of SEQ ID 1048
gtgatggtcgagcgcttgttgtaatgcgcc

SEQ ID NO: 3153 - DNA, 27 bp, Homo sapiens
  mature of SEQ ID 1049
ctcagggagccccaaagggtttatggg

SEQ ID NO: 3154 - DNA, 32 bp, Homo sapiens
  mature of SEQ ID 1050
ggtgctgacagtataggttgacttgaagtaga

SEQ ID NO: 3155 - DNA, 32 bp, Homo sapiens
  mature of SEQ ID 1052
aattggaattatcttttatctttggctacatt

SEQ ID NO: 3156 - DNA, 34 bp, Homo sapiens
  mature of SEQ ID 1052
attatcttttatctttggctacatttatctgagg

SEQ ID NO: 3157 - DNA, 20 bp, Homo sapiens
  mature of SEQ ID 1053
tagtggtcaagcttgtttct

SEQ ID NO: 3158 - DNA, 31 bp, Homo sapiens
  mature of SEQ ID 1056
gttataattatcatgtctctcatttgtattc

SEQ ID NO: 3159 - DNA, 28 bp, Homo sapiens
  mature of SEQ ID 1056
gcacagaaggtgacattctgtctgtaac

SEQ ID NO: 3160 - DNA, 28 bp, Homo sapiens
  mature of SEQ ID 1057
ttttaatgtaatgttattatcctgtcat

SEQ ID NO: 3161 - DNA, 20 bp, Homo sapiens
  mature of SEQ ID 1059
tgttagctgcttgcaaatat

SEQ ID NO: 3162 - DNA, 29 bp, Homo sapiens
  mature of SEQ ID 1060
ttccaagaagatgagcagtttctgggagc

SEQ ID NO: 3163 - DNA, 34 bp, Homo sapiens
  mature of SEQ ID 1062
tacgaggcctgagtgagtctcatttccccagtgc

SEQ ID NO: 3164 - DNA, 32 bp, Homo sapiens
  mature of SEQ ID 1062
cttaatttacgaggcctgagtgagtctcattt

SEQ ID NO: 3165 - DNA, 20 bp, Homo sapiens
  mature of SEQ ID 1062
gggtaatgaactcccattgg

SEQ ID NO: 3166 - DNA, 21 bp, Homo sapiens
  mature of SEQ ID 1063
gttttatttatggctacctat

SEQ ID NO: 3167 - DNA, 33 bp, Homo sapiens
  mature of SEQ ID 1063
gatacataatatttggtagcttgtaaatgaaat

SEQ ID NO: 3168 - DNA, 23 bp, Homo sapiens
  mature of SEQ ID 1064
gctgtagatgaacttgactggcc

SEQ ID NO: 3169 - DNA, 32 bp, Homo sapiens
  mature of SEQ ID 1065
ggcgcgggccggagagcgggtgtgcaaagtgg

SEQ ID NO: 3170 - DNA, 29 bp, Homo sapiens
  mature of SEQ ID 1065
caggggcgcgggccggagagcgggtgtgc

SEQ ID NO: 3171 - DNA, 20 bp, Homo sapiens
  mature of SEQ ID 1067
actctttgttgcaacttgct

SEQ ID NO: 3172 - DNA, 32 bp, Homo sapiens
  mature of SEQ ID 1068
atattaaataggtcaatcagactatgacagct

SEQ ID NO: 3173 - DNA, 30 bp, Homo sapiens
  mature of SEQ ID 1068
tatatatattaaataggtcaatcagactat

SEQ ID NO: 3174 - DNA, 21 bp, Homo sapiens
  mature of SEQ ID 1070
ttaaatctatcctcagttaac

SEQ ID NO: 3175 - DNA, 23 bp, Homo sapiens
  mature of SEQ ID 1070
gattttgcactggggataaatac

SEQ ID NO: 3176 - DNA, 29 bp, Homo sapiens
  mature of SEQ ID 1071
tgcagatggattttttgtgtaagaatgtg

SEQ ID NO: 3177 - DNA, 31 bp, Homo sapiens
  mature of SEQ ID 1072
gctgaagagggaatctataaatgtaatgaat

SEQ ID NO: 3178 - DNA, 29 bp, Homo sapiens
  mature of SEQ ID 1072
tatggctgaagagggaatctataaatgta

SEQ ID NO: 3179 - DNA, 29 bp, Homo sapiens
  mature of SEQ ID 1073
gtgcctcttctccatccagatgtagcagt

SEQ ID NO: 3180 - DNA, 32 bp, Homo sapiens
  mature of SEQ ID 1073
ctcttctccatccagatgtagcagttgttctg

SEQ ID NO: 3181 - DNA, 29 bp, Homo sapiens
  mature of SEQ ID 1075
tgctagaggaaataaatgcctatgtttat

SEQ ID NO: 3182 - DNA, 22 bp, Homo sapiens
  mature of SEQ ID 1076
tatgtgcaatttggctgaatta

SEQ ID NO: 3183 - DNA, 34 bp, Homo sapiens
  mature of SEQ ID 1078
gagtcttctcagctctgacaagctggaagctggc

SEQ ID NO: 3184 - DNA, 30 bp, Homo sapiens
  mature of SEQ ID 1079
tgtaacgctgcaggtgcacaaatgctgata

SEQ ID NO: 3185 - DNA, 32 bp, Homo sapiens
  mature of SEQ ID 1080
gtgaagtgaaatttggtcccaatggaaacctg

SEQ ID NO: 3186 - DNA, 30 bp, Homo sapiens
  mature of SEQ ID 1080
aaaaggtgaagtgaaatttggtcccaatgg

SEQ ID NO: 3187 - DNA, 22 bp, Homo sapiens
  mature of SEQ ID 1082
acagaatagtcaaggctatggt

SEQ ID NO: 3188 - DNA, 23 bp, Homo sapiens
  mature of SEQ ID 1082
tggacttgacaagaccaccaatt

SEQ ID NO: 3189 - DNA, 33 bp, Homo sapiens
  mature of SEQ ID 1083
cccctctgccacgcccccaccttcctggcaggt

SEQ ID NO: 3190 - DNA, 32 bp, Homo sapiens
  mature of SEQ ID 1084
cagattcatgattcatttgttaggggcttagt

SEQ ID NO: 3191 - DNA, 30 bp, Homo sapiens
  mature of SEQ ID 1085
taggttcctgttttcttaaccctgtttgca

SEQ ID NO: 3192 - DNA, 20 bp, Homo sapiens
  mature of SEQ ID 1086
ttctattgtgtttttgcctc

SEQ ID NO: 3193 - DNA, 24 bp, Homo sapiens
  mature of SEQ ID 1086
gcctttactctagggatttataaa

SEQ ID NO: 3194 - DNA, 28 bp, Homo sapiens
  mature of SEQ ID 1087
aggtgttaagctttttaggaagagtgaa

SEQ ID NO: 3195 - DNA, 28 bp, Homo sapiens
  mature of SEQ ID 1088
tgtataactgtatttaaatcatttatat

SEQ ID NO: 3196 - DNA, 19 bp, Homo sapiens
  mature of SEQ ID 1089
gcttgcgcttcttgccgtc

SEQ ID NO: 3197 - DNA, 31 bp, Homo sapiens
  mature of SEQ ID 1090
tggagaattagccgacatatggaaattatcc

SEQ ID NO: 3198 - DNA, 24 bp, Homo sapiens
  mature of SEQ ID 1091
tttgctggaaggtaatttgaattt

SEQ ID NO: 3199 - DNA, 32 bp, Homo sapiens
  mature of SEQ ID 1092
cccagttgctgctattaagttttagtgttatt

SEQ ID NO: 3200 - DNA, 30 bp, Homo sapiens
  mature of SEQ ID 1094
tacaactgtttggatgtcattttacaaaac

SEQ ID NO: 3201 - DNA, 33 bp, Homo sapiens
  mature of SEQ ID 1094
ctgtttggatgtcattttacaaaacaattgcct

SEQ ID NO: 3202 - DNA, 33 bp, Homo sapiens
  mature of SEQ ID 1094
tttcagaaattgatgtcaagaataaaatagctg

SEQ ID NO: 3203 - DNA, 24 bp, Homo sapiens
  mature of SEQ ID 1095
tgcaaaatattaagttatggcaga

SEQ ID NO: 3204 - DNA, 20 bp, Homo sapiens
  mature of SEQ ID 1095
tctgcaaatatttattctgc

SEQ ID NO: 3205 - DNA, 21 bp, Homo sapiens
  mature of SEQ ID 1097
ggggctgatggggtttctaat

SEQ ID NO: 3206 - DNA, 27 bp, Homo sapiens
  mature of SEQ ID 1097
aatttcagaatgttcctgattagatga

SEQ ID NO: 3207 - DNA, 26 bp, Homo sapiens
  mature of SEQ ID 1098
ttagccttcctttcaaaacaaacagg

SEQ ID NO: 3208 - DNA, 25 bp, Homo sapiens
  mature of SEQ ID 1099
gagcaacactcatttaacaagtgca

SEQ ID NO: 3209 - DNA, 33 bp, Homo sapiens
  mature of SEQ ID 1100
tgcatctgactcccatccctggataaatattgt

SEQ ID NO: 3210 - DNA, 31 bp, Homo sapiens
  mature of SEQ ID 1100
ggtcgctgcatctgactcccatccctggata

SEQ ID NO: 3211 - DNA, 26 bp, Homo sapiens
  mature of SEQ ID 1100
ttcagaagctatttaactgggtgacc

SEQ ID NO: 3212 - DNA, 35 bp, Homo sapiens
  mature of SEQ ID 1100
tgcagggaggttcagaagctatttaactgggtgac

SEQ ID NO: 3213 - DNA, 35 bp, Homo sapiens
  mature of SEQ ID 1100
gcaattagaatgcagggaggttcagaagctattta

SEQ ID NO: 3214 - DNA, 21 bp, Homo sapiens
  mature of SEQ ID 1101
agattttgataatagaggtca

SEQ ID NO: 3215 - DNA, 33 bp, Homo sapiens
  mature of SEQ ID 1101
cagaaaggttttcacttaattagaatctcatca

SEQ ID NO: 3216 - DNA, 21 bp, Homo sapiens
  mature of SEQ ID 1102
tgtctttccatcttgttttgg

SEQ ID NO: 3217 - DNA, 19 bp, Homo sapiens
  mature of SEQ ID 1105
agcagattggatccagctt

SEQ ID NO: 3218 - DNA, 27 bp, Homo sapiens
  mature of SEQ ID 1106
gtgaaaatgttggttcaaataaatttc

SEQ ID NO: 3219 - DNA, 30 bp, Homo sapiens
  mature of SEQ ID 1108
tgctaaatattattattattgtttaaatac

SEQ ID NO: 3220 - DNA, 20 bp, Homo sapiens
  mature of SEQ ID 1109
agagaaaggatgatacagtg

SEQ ID NO: 3221 - DNA, 19 bp, Homo sapiens
  mature of SEQ ID 1109
tgctttgctaataaaaccc

SEQ ID NO: 3222 - DNA, 28 bp, Homo sapiens
  mature of SEQ ID 1110
gagagatgagagcagcagttgctgtttt

SEQ ID NO: 3223 - DNA, 32 bp, Homo sapiens
  mature of SEQ ID 1111
cctgaactgacaggctgggcctggctttagat

SEQ ID NO: 3224 - DNA, 29 bp, Homo sapiens
  mature of SEQ ID 1112
ttaaaacaataaaatttacaatttcatta

SEQ ID NO: 3225 - DNA, 19 bp, Homo sapiens
  mature of SEQ ID 1112
taatgaatcataaatttta

SEQ ID NO: 3226 - DNA, 24 bp, Homo sapiens
  mature of SEQ ID 1114
aactccatgaaaaatcaaattagt

SEQ ID NO: 3227 - DNA, 31 bp, Homo sapiens
  mature of SEQ ID 1115
tccaaaaccttctaattttctatacagattc

SEQ ID NO: 3228 - DNA, 25 bp, Homo sapiens
  mature of SEQ ID 1116
atcccaaatatcaatagcttttagt

SEQ ID NO: 3229 - DNA, 19 bp, Homo sapiens
  mature of SEQ ID 1117
ggatataatcagctttgat

SEQ ID NO: 3230 - DNA, 33 bp, Homo sapiens
  mature of SEQ ID 1117
tccaattagagctgttagaggattctggcaggg

SEQ ID NO: 3231 - DNA, 30 bp, Homo sapiens
  mature of SEQ ID 1117
gtttttccaattagagctgttagaggattc

SEQ ID NO: 3232 - DNA, 22 bp, Homo sapiens
  mature of SEQ ID 1118
ggagtaacgggacgtcgccgcg

SEQ ID NO: 3233 - DNA, 21 bp, Homo sapiens
  mature of SEQ ID 1118
gggggcgaggctatgtcgcgg

SEQ ID NO: 3234 - DNA, 19 bp, Homo sapiens
  mature of SEQ ID 1120
gtaattgtctgtcataaat

SEQ ID NO: 3235 - DNA, 19 bp, Homo sapiens
  mature of SEQ ID 1121
ctggatggctcccctgggg

SEQ ID NO: 3236 - DNA, 29 bp, Homo sapiens
  mature of SEQ ID 1121
cggtccccagagggggcagctctaaccct

SEQ ID NO: 3237 - DNA, 31 bp, Homo sapiens
  mature of SEQ ID 1121
ccccagagggggcagctctaaccctaaacaa

SEQ ID NO: 3238 - DNA, 32 bp, Homo sapiens
  mature of SEQ ID 1122
ctcctgatcagaaagaatgtctgtcccacagt

SEQ ID NO: 3239 - DNA, 24 bp, Homo sapiens
  mature of SEQ ID 1122
caggtatgtaactgtggagacagc

SEQ ID NO: 3240 - DNA, 26 bp, Homo sapiens
  mature of SEQ ID 1123
agctacagattttcattataacaatt

SEQ ID NO: 3241 - DNA, 21 bp, Homo sapiens
  mature of SEQ ID 1124
gccattaatcaaatttacaag

SEQ ID NO: 3242 - DNA, 26 bp, Homo sapiens
  mature of SEQ ID 1125
ttattaatggtatgttctttattttg

SEQ ID NO: 3243 - DNA, 27 bp, Homo sapiens
  mature of SEQ ID 1126
tatagcattttaaatacctgtgaacgt

SEQ ID NO: 3244 - DNA, 28 bp, Homo sapiens
  mature of SEQ ID 1127
tactgaatatttcatgtggaattaaggg

SEQ ID NO: 3245 - DNA, 24 bp, Homo sapiens
  mature of SEQ ID 1127
gtgaacccagtaaaaatagcatgg

SEQ ID NO: 3246 - DNA, 22 bp, Homo sapiens
  mature of SEQ ID 1128
ttcttgtgtttcctcttctcct

SEQ ID NO: 3247 - DNA, 31 bp, Homo sapiens
  mature of SEQ ID 1128
gatgaaggagatcctttgcgagaggcatgtt

SEQ ID NO: 3248 - DNA, 29 bp, Homo sapiens
  mature of SEQ ID 1128
gagggatgaaggagatcctttgcgagagg

SEQ ID NO: 3249 - DNA, 33 bp, Homo sapiens
  mature of SEQ ID 1129
gtttgttaggcttcgcatgctggtctccatatg

SEQ ID NO: 3250 - DNA, 30 bp, Homo sapiens
  mature of SEQ ID 1129
gaagtgtttgttaggcttcgcatgctggtc

SEQ ID NO: 3251 - DNA, 24 bp, Homo sapiens
  mature of SEQ ID 1130
atgtaaacaggctaattgtatgca

SEQ ID NO: 3252 - DNA, 31 bp, Homo sapiens
  mature of SEQ ID 1132
tattcttttgttttattgggctatttattct

SEQ ID NO: 3253 - DNA, 21 bp, Homo sapiens
  mature of SEQ ID 1132
gatgtgagttaatggaaccat

SEQ ID NO: 3254 - DNA, 33 bp, Homo sapiens
  mature of SEQ ID 1133
agaaaacaattttgaaagggttatattaaagga

SEQ ID NO: 3255 - DNA, 24 bp, Homo sapiens
  mature of SEQ ID 1134
gagtgtgaactggctccagctgtg

SEQ ID NO: 3256 - DNA, 32 bp, Homo sapiens
  mature of SEQ ID 1134
gtcattaggggtggcagatgaggcaggggact

SEQ ID NO: 3257 - DNA, 30 bp, Homo sapiens
  mature of SEQ ID 1134
ctgctgtcattaggggtggcagatgaggca

SEQ ID NO: 3258 - DNA, 33 bp, Homo sapiens
  mature of SEQ ID 1135
aatggctcgtccatggtgatttttatttggttt

SEQ ID NO: 3259 - DNA, 32 bp, Homo sapiens
  mature of SEQ ID 1136
aagtctgttgaaatgcaccatgaagctttgag

SEQ ID NO: 3260 - DNA, 20 bp, Homo sapiens
  mature of SEQ ID 1136
ctcaaacctggcatggtggt

SEQ ID NO: 3261 - DNA, 30 bp, Homo sapiens
  mature of SEQ ID 1137
agatctctggcagtggaggaagtctcttta

SEQ ID NO: 3262 - DNA, 21 bp, Homo sapiens
  mature of SEQ ID 1138
ggtaaatgatgagcagatgag

SEQ ID NO: 3263 - DNA, 32 bp, Homo sapiens
  mature of SEQ ID 1139
tttcaattacaaaagcctgtttgaacagcctc

SEQ ID NO: 3264 - DNA, 25 bp, Homo sapiens
  mature of SEQ ID 1141
tacatttttagaactaagcagctga

SEQ ID NO: 3265 - DNA, 21 bp, Homo sapiens
  mature of SEQ ID 1141
aatctgtaagttttaattgtg

SEQ ID NO: 3266 - DNA, 20 bp, Homo sapiens
  mature of SEQ ID 1142
ctatgaaaagctagaaagaa

SEQ ID NO: 3267 - DNA, 29 bp, Homo sapiens
  mature of SEQ ID 1143
gctaatggggcttagcaacagatggggag

SEQ ID NO: 3268 - DNA, 32 bp, Homo sapiens
  mature of SEQ ID 1144
tggcaacttcatatttatccactttagctcct

SEQ ID NO: 3269 - DNA, 29 bp, Homo sapiens
  mature of SEQ ID 1144
gccatggcaacttcatatttatccacttt

SEQ ID NO: 3270 - DNA, 34 bp, Homo sapiens
  mature of SEQ ID 1144
aggggaaaagcatataacatattggatgtcaagg

SEQ ID NO: 3271 - DNA, 33 bp, Homo sapiens
  mature of SEQ ID 1145
gagcaaacagtgcaattttctgtaattatgcca

SEQ ID NO: 3272 - DNA, 31 bp, Homo sapiens
  mature of SEQ ID 1145
aaaattgagcaaacagtgcaattttctgtaa

SEQ ID NO: 3273 - DNA, 32 bp, Homo sapiens
  mature of SEQ ID 1145
aataatttacatagttttgcattagctcaatt

SEQ ID NO: 3274 - DNA, 30 bp, Homo sapiens
  mature of SEQ ID 1145
tggtaaataatttacatagttttgcattag

SEQ ID NO: 3275 - DNA, 20 bp, Homo sapiens
  mature of SEQ ID 1146
tattattaaatagcttctgc

SEQ ID NO: 3276 - DNA, 28 bp, Homo sapiens
  mature of SEQ ID 1146
agtgctctgatattcttagatgaaaagt

SEQ ID NO: 3277 - DNA, 26 bp, Homo sapiens
  mature of SEQ ID 1147
ctagattaatggtcctactaaaaatt

SEQ ID NO: 3278 - DNA, 33 bp, Homo sapiens
  mature of SEQ ID 1148
ggtcacatttgttttcttatgcattccttggca

SEQ ID NO: 3279 - DNA, 31 bp, Homo sapiens
  mature of SEQ ID 1148
ggtgagggtcacatttgttttcttatgcatt

SEQ ID NO: 3280 - DNA, 31 bp, Homo sapiens
  mature of SEQ ID 1148
tgccattatcagctaatagatggtcccttgt

SEQ ID NO: 3281 - DNA, 33 bp, Homo sapiens
  mature of SEQ ID 1148
tatcagctaatagatggtcccttgtaaaatgtc

SEQ ID NO: 3282 - DNA, 19 bp, Homo sapiens
  mature of SEQ ID 1149
aggtttatgaagtgtggaa

SEQ ID NO: 3283 - DNA, 23 bp, Homo sapiens
  mature of SEQ ID 1151
gggggcatttgcattttaatggg

SEQ ID NO: 3284 - DNA, 21 bp, Homo sapiens
  mature of SEQ ID 1151
aatgttctctaatggtgggat

SEQ ID NO: 3285 - DNA, 22 bp, Homo sapiens
  mature of SEQ ID 1152
gggagctttcataaaaggacct

SEQ ID NO: 3286 - DNA, 23 bp, Homo sapiens
  mature of SEQ ID 1153
gtctcacatgcaaggtgaaatgg

SEQ ID NO: 3287 - DNA, 31 bp, Homo sapiens
  mature of SEQ ID 1153
tcattaatttatgcaaggtagcagccagcat

SEQ ID NO: 3288 - DNA, 23 bp, Homo sapiens
  mature of SEQ ID 1154
aaagttgtgcatttaatgttcct

SEQ ID NO: 3289 - DNA, 29 bp, Homo sapiens
  mature of SEQ ID 1154
tcctctcctgttgctgttggcagaaacat

SEQ ID NO: 3290 - DNA, 32 bp, Homo sapiens
  mature of SEQ ID 1154
ctcctgttgctgttggcagaaacatatatctt

SEQ ID NO: 3291 - DNA, 27 bp, Homo sapiens
  mature of SEQ ID 1155
gcttgtttaaaatatcatggggttctc

SEQ ID NO: 3292 - DNA, 26 bp, Homo sapiens
  mature of SEQ ID 1156
atgatatctacctcaggatgactgga

SEQ ID NO: 3293 - DNA, 31 bp, Homo sapiens
  mature of SEQ ID 1156
tccaatcaccttttatatcattactggattg

SEQ ID NO: 3294 - DNA, 34 bp, Homo sapiens
  mature of SEQ ID 1156
caccttttatatcattactggattgctgtaagcc

SEQ ID NO: 3295 - DNA, 19 bp, Homo sapiens
  mature of SEQ ID 1157
tgggatgtgcctatggttg

SEQ ID NO: 3296 - DNA, 26 bp, Homo sapiens
  mature of SEQ ID 1157
cctgtaagcaaccataggcttgctct

SEQ ID NO: 3297 - DNA, 27 bp, Homo sapiens
  mature of SEQ ID 1158
acacgacaaatctaaattaacctgaaa

SEQ ID NO: 3298 - DNA, 26 bp, Homo sapiens
  mature of SEQ ID 1159
ttcatttcaaaaggttgaataggatg

SEQ ID NO: 3299 - DNA, 22 bp, Homo sapiens
  mature of SEQ ID 1159
tgtgttgaaatgcagatttccc

SEQ ID NO: 3300 - DNA, 29 bp, Homo sapiens
  mature of SEQ ID 1160
gcagttgtgcaacatgaaaactgcagtga

SEQ ID NO: 3301 - DNA, 31 bp, Homo sapiens
  mature of SEQ ID 1160
ttgtgcaacatgaaaactgcagtgacatgtt

SEQ ID NO: 3302 - DNA, 32 bp, Homo sapiens
  mature of SEQ ID 1161
attcttgatttagttttgagagaaaagggttt

SEQ ID NO: 3303 - DNA, 30 bp, Homo sapiens
  mature of SEQ ID 1161
ctaccattcttgatttagttttgagagaaa

SEQ ID NO: 3304 - DNA, 23 bp, Homo sapiens
  mature of SEQ ID 1161
cagctggagatggctggaaagtc

SEQ ID NO: 3305 - DNA, 28 bp, Homo sapiens
  mature of SEQ ID 1162
gacacatctgtggtgctgtccatggaca

SEQ ID NO: 3306 - DNA, 28 bp, Homo sapiens
  mature of SEQ ID 1163
ttggtgtggagtttttctacttatggca

SEQ ID NO: 3307 - DNA, 32 bp, Homo sapiens
  mature of SEQ ID 1164
ttggcctttagcatatgttgctggcacagcag

SEQ ID NO: 3308 - DNA, 29 bp, Homo sapiens
  mature of SEQ ID 1164
taaattggcctttagcatatgttgctggc

SEQ ID NO: 3309 - DNA, 30 bp, Homo sapiens
  mature of SEQ ID 1165
tcatctcggggcctggtgaattaggacgac

SEQ ID NO: 3310 - DNA, 32 bp, Homo sapiens
  mature of SEQ ID 1165
tcggggcctggtgaattaggacgacatcggca

SEQ ID NO: 3311 - DNA, 30 bp, Homo sapiens
  mature of SEQ ID 1165
tgctaaagacgtccagattgatccagccct

SEQ ID NO: 3312 - DNA, 32 bp, Homo sapiens
  mature of SEQ ID 1165
aagacgtccagattgatccagcccttggctga

SEQ ID NO: 3313 - DNA, 23 bp, Homo sapiens
  mature of SEQ ID 1168
gaagtgaaggcttaatgagcaga

SEQ ID NO: 3314 - DNA, 23 bp, Homo sapiens
  mature of SEQ ID 1168
gtcttcttaaatggcagcatttt

SEQ ID NO: 3315 - DNA, 32 bp, Homo sapiens
  mature of SEQ ID 1169
atgttcattttgtatgtaacctagacagttgc

SEQ ID NO: 3316 - DNA, 23 bp, Homo sapiens
  mature of SEQ ID 1170
gggcaggtccaaagccttcagca

SEQ ID NO: 3317 - DNA, 33 bp, Homo sapiens
  mature of SEQ ID 1171
gccaggcagatttgctcactcaagaaaatctgt

SEQ ID NO: 3318 - DNA, 27 bp, Homo sapiens
  mature of SEQ ID 1172
atccttcacagcttgctcccaagtcca

SEQ ID NO: 3319 - DNA, 31 bp, Homo sapiens
  mature of SEQ ID 1172
ggcctgtcttgggggtagctttgtggcctga

SEQ ID NO: 3320 - DNA, 32 bp, Homo sapiens
  mature of SEQ ID 1173
cgaggtgaacaatggctggctctgtccctgag

SEQ ID NO: 3321 - DNA, 29 bp, Homo sapiens
  mature of SEQ ID 1173
ttaacgaggtgaacaatggctggctctgt

SEQ ID NO: 3322 - DNA, 20 bp, Homo sapiens
  mature of SEQ ID 1173
cttaggggtgggggagccct

SEQ ID NO: 3323 - DNA, 32 bp, Homo sapiens
  mature of SEQ ID 1174
ctttccccctcccatgtgctttccttcatttg

SEQ ID NO: 3324 - DNA, 30 bp, Homo sapiens
  mature of SEQ ID 1174
atcacctttccccctcccatgtgctttcct

SEQ ID NO: 3325 - DNA, 25 bp, Homo sapiens
  mature of SEQ ID 1174
tttatttgggagggggaagggtgat

SEQ ID NO: 3326 - DNA, 35 bp, Homo sapiens
  mature of SEQ ID 1175
gataataccggcacctcttttcactctaatctcct

SEQ ID NO: 3327 - DNA, 35 bp, Homo sapiens
  mature of SEQ ID 1175
gcacctcttttcactctaatctcctacccgtctga

SEQ ID NO: 3328 - DNA, 26 bp, Homo sapiens
  mature of SEQ ID 1175
tcactctaatctcctacccgtctgag

SEQ ID NO: 3329 - DNA, 23 bp, Homo sapiens
  mature of SEQ ID 1175
ttcagcaggagataggggcatta

SEQ ID NO: 3330 - DNA, 32 bp, Homo sapiens
  mature of SEQ ID 1176
aaactagaagcagcagaaaactagcttgtaaa

SEQ ID NO: 3331 - DNA, 30 bp, Homo sapiens
  mature of SEQ ID 1176
gtttaaaactagaagcagcagaaaactagc

SEQ ID NO: 3332 - DNA, 28 bp, Homo sapiens
  mature of SEQ ID 1176
tgcaggctaggctgtcttggggaaataa

SEQ ID NO: 3333 - DNA, 23 bp, Homo sapiens
  mature of SEQ ID 1177
tttatcctgctgtgtttccaatc

SEQ ID NO: 3334 - DNA, 23 bp, Homo sapiens
  mature of SEQ ID 1178
tggacatccatttagcttcaggt

SEQ ID NO: 3335 - DNA, 29 bp, Homo sapiens
  mature of SEQ ID 1179
gtgtagattaggagtcagagcagtcaatg

SEQ ID NO: 3336 - DNA, 31 bp, Homo sapiens
  mature of SEQ ID 1179
agattaggagtcagagcagtcaatgagctgt

SEQ ID NO: 3337 - DNA, 31 bp, Homo sapiens
  mature of SEQ ID 1180
tctaatccatagggattactgtggcagaatg

SEQ ID NO: 3338 - DNA, 23 bp, Homo sapiens
  mature of SEQ ID 1182
tcctcattaaaatggaagcccat

SEQ ID NO: 3339 - DNA, 24 bp, Homo sapiens
  mature of SEQ ID 1183
gacacagagcccaggttccattaa

SEQ ID NO: 3340 - DNA, 30 bp, Homo sapiens
  mature of SEQ ID 1183
ttaatgccaaggtctgtgcaattagtgaaa

SEQ ID NO: 3341 - DNA, 29 bp, Homo sapiens
  mature of SEQ ID 1184
ggtttttggaagctggcatggactagatt

SEQ ID NO: 3342 - DNA, 21 bp, Homo sapiens
  mature of SEQ ID 1185
ggatcatgttagcttaactta

SEQ ID NO: 3343 - DNA, 35 bp, Homo sapiens
  mature of SEQ ID 1186
aaatagtaaattgcctaaatattgaacacatgtat

SEQ ID NO: 3344 - DNA, 32 bp, Homo sapiens
  mature of SEQ ID 1186
aagataaaaatagtaaattgcctaaatattga

SEQ ID NO: 3345 - DNA, 32 bp, Homo sapiens
  mature of SEQ ID 1187
agctaattagtttcttttcaagtaattgcaaa

SEQ ID NO: 3346 - DNA, 19 bp, Homo sapiens
  mature of SEQ ID 1189
caaagttcttttgaattat

SEQ ID NO: 3347 - DNA, 34 bp, Homo sapiens
  mature of SEQ ID 1190
acgcaatcagtgtttgcatggcacctgcggccac

SEQ ID NO: 3348 - DNA, 31 bp, Homo sapiens
  mature of SEQ ID 1190
gcgattgggcaggcttcatgcaggcagctgg

SEQ ID NO: 3349 - DNA, 33 bp, Homo sapiens
  mature of SEQ ID 1190
gggcaggcttcatgcaggcagctggcgtctagg

SEQ ID NO: 3350 - DNA, 20 bp, Homo sapiens
  mature of SEQ ID 1191
cttgccaagagaatggtaac

SEQ ID NO: 3351 - DNA, 23 bp, Homo sapiens
  mature of SEQ ID 1192
cagggtttgtggatttgatcttg

SEQ ID NO: 3352 - DNA, 24 bp, Homo sapiens
  mature of SEQ ID 1192
ttaagttattccacatctcaccca

SEQ ID NO: 3353 - DNA, 31 bp, Homo sapiens
  mature of SEQ ID 1193
gggtattaataacaccgttgctgtttttaat

SEQ ID NO: 3354 - DNA, 31 bp, Homo sapiens
  mature of SEQ ID 1193
aattccatcaatgctgtttgttttggtgccc

SEQ ID NO: 3355 - DNA, 29 bp, Homo sapiens
  mature of SEQ ID 1193
attaaattccatcaatgctgtttgttttg

SEQ ID NO: 3356 - DNA, 27 bp, Homo sapiens
  mature of SEQ ID 1194
tgatatccttgtttttaactgttgtgg

SEQ ID NO: 3357 - DNA, 23 bp, Homo sapiens
  mature of SEQ ID 1195
atataaattacaatcagattatg

SEQ ID NO: 3358 - DNA, 28 bp, Homo sapiens
  mature of SEQ ID 1196
ttatcgctcgggccaggcggaggccggg

SEQ ID NO: 3359 - DNA, 32 bp, Homo sapiens
  mature of SEQ ID 1196
ggcttccggaggcgcccgggcgggatgagctc

SEQ ID NO: 3360 - DNA, 30 bp, Homo sapiens
  mature of SEQ ID 1196
cccgtggcttccggaggcgcccgggcggga

SEQ ID NO: 3361 - DNA, 32 bp, Homo sapiens
  mature of SEQ ID 1197
aacatctgtttgaggctgggacacctggctga

SEQ ID NO: 3362 - DNA, 35 bp, Homo sapiens
  mature of SEQ ID 1197
gtttgaggctgggacacctggctgagcccagcaca

SEQ ID NO: 3363 - DNA, 25 bp, Homo sapiens
  mature of SEQ ID 1198
ggggcggggaggaattccggttctc

SEQ ID NO: 3364 - DNA, 27 bp, Homo sapiens
  mature of SEQ ID 1199
aaaagctgcttgcattaagatccatgt

SEQ ID NO: 3365 - DNA, 34 bp, Homo sapiens
  mature of SEQ ID 1200
tgctgaagccattcgccttccagcatcttcaatc

SEQ ID NO: 3366 - DNA, 27 bp, Homo sapiens
  mature of SEQ ID 1201
aagtaggaattggggctctgcaccagg

SEQ ID NO: 3367 - DNA, 32 bp, Homo sapiens
  mature of SEQ ID 1201
tgtttcctcttctcctcttctggagagggatg

SEQ ID NO: 3368 - DNA, 30 bp, Homo sapiens
  mature of SEQ ID 1201
tcttgtgtttcctcttctcctcttctggag

SEQ ID NO: 3369 - DNA, 21 bp, Homo sapiens
  mature of SEQ ID 1203
tgtttacaaatactccagggt

SEQ ID NO: 3370 - DNA, 21 bp, Homo sapiens
  mature of SEQ ID 1204
aagtttaattagccagtgttt

SEQ ID NO: 3371 - DNA, 23 bp, Homo sapiens
  mature of SEQ ID 1204
ttgaagctgaaaagtgctaatta

SEQ ID NO: 3372 - DNA, 33 bp, Homo sapiens
  mature of SEQ ID 1205
ttttctgtaacagtcatttgacatttaatatac

SEQ ID NO: 3373 - DNA, 30 bp, Homo sapiens
  mature of SEQ ID 1205
agtgcttttctgtaacagtcatttgacatt

SEQ ID NO: 3374 - DNA, 32 bp, Homo sapiens
  mature of SEQ ID 1205
gtattattaaatttaaatgcatatttgcaatt

SEQ ID NO: 3375 - DNA, 35 bp, Homo sapiens
  mature of SEQ ID 1205
taaatttaaatgcatatttgcaattctaaaagcac

SEQ ID NO: 3376 - DNA, 27 bp, Homo sapiens
  mature of SEQ ID 1206
tggtaaatcactgagatccaaactata

SEQ ID NO: 3377 - DNA, 20 bp, Homo sapiens
  mature of SEQ ID 1206
gtcagtgaccactcagtggc

SEQ ID NO: 3378 - DNA, 23 bp, Homo sapiens
  mature of SEQ ID 1207
tagacaatgaaaaaccctgcatg

SEQ ID NO: 3379 - DNA, 23 bp, Homo sapiens
  mature of SEQ ID 1207
taggtttatgtgaaacttctgga

SEQ ID NO: 3380 - DNA, 29 bp, Homo sapiens
  mature of SEQ ID 1210
ttattggcaatctcactgtcctccaaatg

SEQ ID NO: 3381 - DNA, 23 bp, Homo sapiens
  mature of SEQ ID 1212
gcaaagtctgttattggtgatga

SEQ ID NO: 3382 - DNA, 21 bp, Homo sapiens
  mature of SEQ ID 1212
cacacgtgccagacagattct

SEQ ID NO: 3383 - DNA, 32 bp, Homo sapiens
  mature of SEQ ID 1213
gtcattttgatagagcaaaagacaatctgtct

SEQ ID NO: 3384 - DNA, 29 bp, Homo sapiens
  mature of SEQ ID 1213
aactgtcattttgatagagcaaaagacaa

SEQ ID NO: 3385 - DNA, 26 bp, Homo sapiens
  mature of SEQ ID 1213
tccttctaattatgaatgttgcagtt

SEQ ID NO: 3386 - DNA, 21 bp, Homo sapiens
  mature of SEQ ID 1214
tatagagcacttgtctgttta

SEQ ID NO: 3387 - DNA, 30 bp, Homo sapiens
  mature of SEQ ID 1215
gtgtatagttttttaaacctcattattagc

SEQ ID NO: 3388 - DNA, 33 bp, Homo sapiens
  mature of SEQ ID 1215
tagttttttaaacctcattattagccttgtatg

SEQ ID NO: 3389 - DNA, 33 bp, Homo sapiens
  mature of SEQ ID 1215
catgtcaggctcccgatgagtgtaattgtatac

SEQ ID NO: 3390 - DNA, 33 bp, Homo sapiens
  mature of SEQ ID 1216
tgtcaaaagagaataatcctatgtcaaagtggc

SEQ ID NO: 3391 - DNA, 20 bp, Homo sapiens
  mature of SEQ ID 1217
attaaccagtactagacagc

SEQ ID NO: 3392 - DNA, 26 bp, Homo sapiens
  mature of SEQ ID 1217
tgctcgctaactataaactatctgat

SEQ ID NO: 3393 - DNA, 20 bp, Homo sapiens
  mature of SEQ ID 1218
gtaattatccagatttcctt

SEQ ID NO: 3394 - DNA, 20 bp, Homo sapiens
  mature of SEQ ID 1219
agaggtgtataggccaacat

SEQ ID NO: 3395 - DNA, 20 bp, Homo sapiens
  mature of SEQ ID 1221
ctttccccagattgctctgg

SEQ ID NO: 3396 - DNA, 21 bp, Homo sapiens
  mature of SEQ ID 1222
atcttgaacttgagtctaaag

SEQ ID NO: 3397 - DNA, 19 bp, Homo sapiens
  mature of SEQ ID 1224
ttatcaagggaagaggcgc

SEQ ID NO: 3398 - DNA, 24 bp, Homo sapiens
  mature of SEQ ID 1224
ggaaatgagtgccaggcttttctt

SEQ ID NO: 3399 - DNA, 27 bp, Homo sapiens
  mature of SEQ ID 1225
ctaagtaaatatttctatggtgatagt

SEQ ID NO: 3400 - DNA, 29 bp, Homo sapiens
  mature of SEQ ID 1225
atacaatggccattatttaatgttaatac

SEQ ID NO: 3401 - DNA, 32 bp, Homo sapiens
  mature of SEQ ID 1225
aatggccattatttaatgttaatacaagtacc

SEQ ID NO: 3402 - DNA, 31 bp, Homo sapiens
  mature of SEQ ID 1226
attacttttcttggcccaactgtggagctgg

SEQ ID NO: 3403 - DNA, 29 bp, Homo sapiens
  mature of SEQ ID 1226
tgtaattacttttcttggcccaactgtgg

SEQ ID NO: 3404 - DNA, 26 bp, Homo sapiens
  mature of SEQ ID 1227
taaagtacttcttggttgctattagg

SEQ ID NO: 3405 - DNA, 19 bp, Homo sapiens
  mature of SEQ ID 1227
gacctttggcaattgtgat

SEQ ID NO: 3406 - DNA, 24 bp, Homo sapiens
  mature of SEQ ID 1228
tgtttgctagtaaaatttattacc

SEQ ID NO: 3407 - DNA, 19 bp, Homo sapiens
  mature of SEQ ID 1228
gtttttgggaaaggtttta

SEQ ID NO: 3408 - DNA, 19 bp, Homo sapiens
  mature of SEQ ID 1229
tggaagggtctgaaggccc

SEQ ID NO: 3409 - DNA, 19 bp, Homo sapiens
  mature of SEQ ID 1229
tgtagttatgagcagtaac

SEQ ID NO: 3410 - DNA, 26 bp, Homo sapiens
  mature of SEQ ID 1230
aatttctgtttgaagaatcaacctga

SEQ ID NO: 3411 - DNA, 21 bp, Homo sapiens
  mature of SEQ ID 1230
atcagattgtctcatttaaat

SEQ ID NO: 3412 - DNA, 32 bp, Homo sapiens
  mature of SEQ ID 1231
ttacgtccatctatctttatattccagcggca

SEQ ID NO: 3413 - DNA, 32 bp, Homo sapiens
  mature of SEQ ID 1231
tctggaatgaactgaaatagtgtttggtttgt

SEQ ID NO: 3414 - DNA, 30 bp, Homo sapiens
  mature of SEQ ID 1231
tgctgtctggaatgaactgaaatagtgttt

SEQ ID NO: 3415 - DNA, 27 bp, Homo sapiens
  mature of SEQ ID 1232
tcattatgtagagtcaggcaaaagaca

SEQ ID NO: 3416 - DNA, 20 bp, Homo sapiens
  mature of SEQ ID 1233
gggattctggccaaatccct

SEQ ID NO: 3417 - DNA, 29 bp, Homo sapiens
  mature of SEQ ID 1233
agttgcttggcacagaattattgattggc

SEQ ID NO: 3418 - DNA, 30 bp, Homo sapiens
  mature of SEQ ID 1234
aaaattaatgttctgcatttaatctcagct

SEQ ID NO: 3419 - DNA, 23 bp, Homo sapiens
  mature of SEQ ID 1236
tgttcctctgagtcattgtcatg

SEQ ID NO: 3420 - DNA, 21 bp, Homo sapiens
  mature of SEQ ID 1237
gagatgcagtttttccagcaa

SEQ ID NO: 3421 - DNA, 24 bp, Homo sapiens
  mature of SEQ ID 1237
tggtaaaatggaaagataattcaa

SEQ ID NO: 3422 - DNA, 33 bp, Homo sapiens
  mature of SEQ ID 1238
gcccccaaacatcttatttgtcttgatatttct

SEQ ID NO: 3423 - DNA, 31 bp, Homo sapiens
  mature of SEQ ID 1238
tggtgtgcccccaaacatcttatttgtcttg

SEQ ID NO: 3424 - DNA, 25 bp, Homo sapiens
  mature of SEQ ID 1238
agaaatacatatgacagataaggag

SEQ ID NO: 3425 - DNA, 32 bp, Homo sapiens
  mature of SEQ ID 1239
ctaggcacaatggctgtggataaatatgtttc

SEQ ID NO: 3426 - DNA, 24 bp, Homo sapiens
  mature of SEQ ID 1239
atcatttacataccatatgccctg

SEQ ID NO: 3427 - DNA, 27 bp, Homo sapiens
  mature of SEQ ID 1241
cactctgaagttagatttcacagaaag

SEQ ID NO: 3428 - DNA, 34 bp, Homo sapiens
  mature of SEQ ID 1242
ctgtaaaatgaatttctgatctcagtccagtcat

SEQ ID NO: 3429 - DNA, 32 bp, Homo sapiens
  mature of SEQ ID 1242
atggttggaaactgaggtgagcaggcatttag

SEQ ID NO: 3430 - DNA, 32 bp, Homo sapiens
  mature of SEQ ID 1243
gatgatgtatgcagtttctttaaaaacaaacc

SEQ ID NO: 3431 - DNA, 33 bp, Homo sapiens
  mature of SEQ ID 1243
atacagaaactgcatggtatttaaattattgtt

SEQ ID NO: 3432 - DNA, 24 bp, Homo sapiens
  mature of SEQ ID 1244
gtttctaaataaggttgggagggt

SEQ ID NO: 3433 - DNA, 34 bp, Homo sapiens
  mature of SEQ ID 1244
cttctcggcccgccgcccttcctgtctcggggac

SEQ ID NO: 3434 - DNA, 32 bp, Homo sapiens
  mature of SEQ ID 1244
ctccgtgcttctcggcccgccgcccttcctgt

SEQ ID NO: 3435 - DNA, 20 bp, Homo sapiens
  mature of SEQ ID 1245
agagataatggatgtgaaaa

SEQ ID NO: 3436 - DNA, 25 bp, Homo sapiens
  mature of SEQ ID 1245
ggggattattgctattatttctagg

SEQ ID NO: 3437 - DNA, 19 bp, Homo sapiens
  mature of SEQ ID 1248
acaaagaagtatttattgt

SEQ ID NO: 3438 - DNA, 32 bp, Homo sapiens
  mature of SEQ ID 1248
ttttcccagagaatgcctttcagaattgctgt

SEQ ID NO: 3439 - DNA, 22 bp, Homo sapiens
  mature of SEQ ID 1249
tgtggtttctctcatcctgtta

SEQ ID NO: 3440 - DNA, 28 bp, Homo sapiens
  mature of SEQ ID 1251
gcaggtgacatcggagaaacatgagtga

SEQ ID NO: 3441 - DNA, 32 bp, Homo sapiens
  mature of SEQ ID 1251
ctgaatttcttcatgttgatgttccttcacct

SEQ ID NO: 3442 - DNA, 30 bp, Homo sapiens
  mature of SEQ ID 1251
acattctgaatttcttcatgttgatgttcc

SEQ ID NO: 3443 - DNA, 30 bp, Homo sapiens
  mature of SEQ ID 1252
ccctaggaagtttattaaaaatgctaaatc

SEQ ID NO: 3444 - DNA, 33 bp, Homo sapiens
  mature of SEQ ID 1252
ggaagtttattaaaaatgctaaatcaggagctg

SEQ ID NO: 3445 - DNA, 19 bp, Homo sapiens
  mature of SEQ ID 1252
gcttaaatagcttgaagta

SEQ ID NO: 3446 - DNA, 22 bp, Homo sapiens
  mature of SEQ ID 1253
tggaaacaacttgaccaaaaat

SEQ ID NO: 3447 - DNA, 26 bp, Homo sapiens
  mature of SEQ ID 1253
tgtggcagttttaagttattagtttt

SEQ ID NO: 3448 - DNA, 19 bp, Homo sapiens
  mature of SEQ ID 1255
tggtccttgcacattatct

SEQ ID NO: 3449 - DNA, 19 bp, Homo sapiens
  mature of SEQ ID 1255
gagtgtgatttaagggcta

SEQ ID NO: 3450 - DNA, 28 bp, Homo sapiens
  mature of SEQ ID 1257
actagcattttgttttggaaaatagttc

SEQ ID NO: 3451 - DNA, 24 bp, Homo sapiens
  mature of SEQ ID 1257
gtggaatatttttcaatgcagtaa

SEQ ID NO: 3452 - DNA, 25 bp, Homo sapiens
  mature of SEQ ID 1258
tcagcttttaagagtctttggtttc

SEQ ID NO: 3453 - DNA, 19 bp, Homo sapiens
  mature of SEQ ID 1258
tggacgccacagttcttca

SEQ ID NO: 3454 - DNA, 24 bp, Homo sapiens
  mature of SEQ ID 1259
gtggtctgtgtgtctgagtcagag

SEQ ID NO: 3455 - DNA, 34 bp, Homo sapiens
  mature of SEQ ID 1259
gggttctttgaattgatggctcactcccagccac

SEQ ID NO: 3456 - DNA, 19 bp, Homo sapiens
  mature of SEQ ID 1263
cacagctggcaaattgaca

SEQ ID NO: 3457 - DNA, 19 bp, Homo sapiens
  mature of SEQ ID 1263
attgttaaacagttcattt

SEQ ID NO: 3458 - DNA, 29 bp, Homo sapiens
  mature of SEQ ID 1264
gtcacagaccacaacaaagcccttcctgg

SEQ ID NO: 3459 - DNA, 32 bp, Homo sapiens
  mature of SEQ ID 1264
cagaccacaacaaagcccttcctggcatgtcg

SEQ ID NO: 3460 - DNA, 32 bp, Homo sapiens
  mature of SEQ ID 1265
tttttaagatttgcttgagagatggagtaaca

SEQ ID NO: 3461 - DNA, 32 bp, Homo sapiens
  mature of SEQ ID 1267
atttaatgtaatttccctaaaatggaggtaat

SEQ ID NO: 3462 - DNA, 29 bp, Homo sapiens
  mature of SEQ ID 1269
gttcatttgtctttattatgattccatga

SEQ ID NO: 3463 - DNA, 31 bp, Homo sapiens
  mature of SEQ ID 1269
atttgtctttattatgattccatgattactt

SEQ ID NO: 3464 - DNA, 32 bp, Homo sapiens
  mature of SEQ ID 1270
ttggactaaatcatggcaattagtgtaacgga

SEQ ID NO: 3465 - DNA, 34 bp, Homo sapiens
  mature of SEQ ID 1270
aaatcatggcaattagtgtaacggaaatgtttac

SEQ ID NO: 3466 - DNA, 20 bp, Homo sapiens
  mature of SEQ ID 1272
ggggctgccatcctgctgtc

SEQ ID NO: 3467 - DNA, 27 bp, Homo sapiens
  mature of SEQ ID 1274
ctagttatttattaataatgagagctg

SEQ ID NO: 3468 - DNA, 27 bp, Homo sapiens
  mature of SEQ ID 1274
ctcaaattataaatctagtaaagatgg

SEQ ID NO: 3469 - DNA, 26 bp, Homo sapiens
  mature of SEQ ID 1275
tgggatctgatcaattagtcattagg

SEQ ID NO: 3470 - DNA, 33 bp, Homo sapiens
  mature of SEQ ID 1275
ctaattgcataaattcctttaggccactcagag

SEQ ID NO: 3471 - DNA, 31 bp, Homo sapiens
  mature of SEQ ID 1275
cctaaactaattgcataaattcctttaggcc

SEQ ID NO: 3472 - DNA, 19 bp, Homo sapiens
  mature of SEQ ID 1276
tcttcattagaatttgaag

SEQ ID NO: 3473 - DNA, 24 bp, Homo sapiens
  mature of SEQ ID 1276
agaacatgggaattttaaattcac

SEQ ID NO: 3474 - DNA, 28 bp, Homo sapiens
  mature of SEQ ID 1277
agaggggtgactgcggggcttgttgcgc

SEQ ID NO: 3475 - DNA, 34 bp, Homo sapiens
  mature of SEQ ID 1278
ggctaatgagctttgaaacattaagagaaaagag

SEQ ID NO: 3476 - DNA, 32 bp, Homo sapiens
  mature of SEQ ID 1278
atcgtttggctaatgagctttgaaacattaag

SEQ ID NO: 3477 - DNA, 27 bp, Homo sapiens
  mature of SEQ ID 1280
aatgtcatgtatttacataattagcat

SEQ ID NO: 3478 - DNA, 19 bp, Homo sapiens
  mature of SEQ ID 1280
gtgtaaatatatgtaatta

SEQ ID NO: 3479 - DNA, 24 bp, Homo sapiens
  mature of SEQ ID 1281
atactgctgtgactgaaatatgca

SEQ ID NO: 3480 - DNA, 20 bp, Homo sapiens
  mature of SEQ ID 1281
ttggtagacataaattaagg

SEQ ID NO: 3481 - DNA, 23 bp, Homo sapiens
  mature of SEQ ID 1282
acaatgaagttaatttttaaaaa

SEQ ID NO: 3482 - DNA, 29 bp, Homo sapiens
  mature of SEQ ID 1282
ccctattaattttattgtttcaataaagc

SEQ ID NO: 3483 - DNA, 23 bp, Homo sapiens
  mature of SEQ ID 1283
ggatttctaattcgatttgttgg

SEQ ID NO: 3484 - DNA, 20 bp, Homo sapiens
  mature of SEQ ID 1284
ttgatgaatattgatggtgc

SEQ ID NO: 3485 - DNA, 33 bp, Homo sapiens
  mature of SEQ ID 1287
ctcctcaaacaggttccatatggccctcccggc

SEQ ID NO: 3486 - DNA, 29 bp, Homo sapiens
  mature of SEQ ID 1288
aattctcacttaggtgttagggatttaat

SEQ ID NO: 3487 - DNA, 31 bp, Homo sapiens
  mature of SEQ ID 1288
ctcacttaggtgttagggatttaatgatact

SEQ ID NO: 3488 - DNA, 29 bp, Homo sapiens
  mature of SEQ ID 1288
tatttttactacctgagggtggggaatgg

SEQ ID NO: 3489 - DNA, 24 bp, Homo sapiens
  mature of SEQ ID 1290
gaagttgttagtggcttggatggt

SEQ ID NO: 3490 - DNA, 22 bp, Homo sapiens
  mature of SEQ ID 1291
tatatttagcatattggaagga

SEQ ID NO: 3491 - DNA, 19 bp, Homo sapiens
  mature of SEQ ID 1292
caagttgaaaatgaaaata

SEQ ID NO: 3492 - DNA, 20 bp, Homo sapiens
  mature of SEQ ID 1292
tgttttacttcagctgctcc

SEQ ID NO: 3493 - DNA, 19 bp, Homo sapiens
  mature of SEQ ID 1292
ctttcatttgttaatatat

SEQ ID NO: 3494 - DNA, 20 bp, Homo sapiens
  mature of SEQ ID 1293
gcctggctacctctaatctc

SEQ ID NO: 3495 - DNA, 21 bp, Homo sapiens
  mature of SEQ ID 1294
gtgttctgaatattaaaatag

SEQ ID NO: 3496 - DNA, 24 bp, Homo sapiens
  mature of SEQ ID 1296
agcctcccccagactccaccagct

SEQ ID NO: 3497 - DNA, 29 bp, Homo sapiens
  mature of SEQ ID 1299
gtcatgatgttgcgtcaccacgtgatgac

SEQ ID NO: 3498 - DNA, 31 bp, Homo sapiens
  mature of SEQ ID 1299
tgatgttgcgtcaccacgtgatgacgctgtg

SEQ ID NO: 3499 - DNA, 32 bp, Homo sapiens
  mature of SEQ ID 1299
cacatcatcgcatattgacacaatgtcatggc

SEQ ID NO: 3500 - DNA, 33 bp, Homo sapiens
  mature of SEQ ID 1303
tagatgtgaatgttaatcactgcttgactatgt

SEQ ID NO: 3501 - DNA, 30 bp, Homo sapiens
  mature of SEQ ID 1303
cataatagatgtgaatgttaatcactgctt

SEQ ID NO: 3502 - DNA, 30 bp, Homo sapiens
  mature of SEQ ID 1303
atattgtactgtagtaattttgtatttaca

SEQ ID NO: 3503 - DNA, 33 bp, Homo sapiens
  mature of SEQ ID 1303
gtactgtagtaattttgtatttacatttgtatg

SEQ ID NO: 3504 - DNA, 23 bp, Homo sapiens
  mature of SEQ ID 1304
catttgttttcagtgtgtttatg

SEQ ID NO: 3505 - DNA, 22 bp, Homo sapiens
  mature of SEQ ID 1304
taattatgctttttaacaaatg

SEQ ID NO: 3506 - DNA, 29 bp, Homo sapiens
  mature of SEQ ID 1305
gacatagataatttttgaattctgataga

SEQ ID NO: 3507 - DNA, 21 bp, Homo sapiens
  mature of SEQ ID 1306
gcaagcagaaattgaacttga

SEQ ID NO: 3508 - DNA, 29 bp, Homo sapiens
  mature of SEQ ID 1307
tgtccataaacctttgaatacttatagag

SEQ ID NO: 3509 - DNA, 22 bp, Homo sapiens
  mature of SEQ ID 1307
ttttctgaggttcaacacatct

SEQ ID NO: 3510 - DNA, 27 bp, Homo sapiens
  mature of SEQ ID 1308
tctgggattactgaaggtcatacagct

SEQ ID NO: 3511 - DNA, 31 bp, Homo sapiens
  mature of SEQ ID 1310
atcttgtcatctagtggcgacaaagtccagc

SEQ ID NO: 3512 - DNA, 21 bp, Homo sapiens
  mature of SEQ ID 1310
taagtcccttgagatacacag

SEQ ID NO: 3513 - DNA, 22 bp, Homo sapiens
  mature of SEQ ID 1311
ttctggagatcataaagaaatc

SEQ ID NO: 3514 - DNA, 25 bp, Homo sapiens
  mature of SEQ ID 1311
taaataatcatttctgttatgtcag

SEQ ID NO: 3515 - DNA, 23 bp, Homo sapiens
  mature of SEQ ID 1313
agacctccctgagccagcaaagt

SEQ ID NO: 3516 - DNA, 32 bp, Homo sapiens
  mature of SEQ ID 1314
attgcttttaagctatttgtctccatttggga

SEQ ID NO: 3517 - DNA, 29 bp, Homo sapiens
  mature of SEQ ID 1314
taatattgcttttaagctatttgtctcca

SEQ ID NO: 3518 - DNA, 26 bp, Homo sapiens
  mature of SEQ ID 1315
tattttaattcagaccccagggacct

SEQ ID NO: 3519 - DNA, 27 bp, Homo sapiens
  mature of SEQ ID 1315
gctatttggatttgattttttaaagta

SEQ ID NO: 3520 - DNA, 28 bp, Homo sapiens
  mature of SEQ ID 1316
ttccttaaaatcaacataaaaaccttgc

SEQ ID NO: 3521 - DNA, 29 bp, Homo sapiens
  mature of SEQ ID 1316
tttcatgccaggtttgacaggtggtgata

SEQ ID NO: 3522 - DNA, 25 bp, Homo sapiens
  mature of SEQ ID 1317
cccttctatgtatttatatcatgag

SEQ ID NO: 3523 - DNA, 19 bp, Homo sapiens
  mature of SEQ ID 1318
gatgaggaagatgtagtcc

SEQ ID NO: 3524 - DNA, 31 bp, Homo sapiens
  mature of SEQ ID 1319
ttaaaagagctacttcattcctgctgagcta

SEQ ID NO: 3525 - DNA, 29 bp, Homo sapiens
  mature of SEQ ID 1319
tgagttaaaagagctacttcattcctgct

SEQ ID NO: 3526 - DNA, 34 bp, Homo sapiens
  mature of SEQ ID 1322
tgtggatgataaaactttaattaaagtggtgatt

SEQ ID NO: 3527 - DNA, 29 bp, Homo sapiens
  mature of SEQ ID 1322
ataatgaccactaataaagtagtttatag

SEQ ID NO: 3528 - DNA, 32 bp, Homo sapiens
  mature of SEQ ID 1323
ggaccttctggaggtaaatctgcagaatggca

SEQ ID NO: 3529 - DNA, 32 bp, Homo sapiens
  mature of SEQ ID 1324
taggcctggccttggtttgatagagctctcct

SEQ ID NO: 3530 - DNA, 33 bp, Homo sapiens
  mature of SEQ ID 1324
taaagctttctctttgcaactaattatggcctg

SEQ ID NO: 3531 - DNA, 31 bp, Homo sapiens
  mature of SEQ ID 1324
ggatgttaaagctttctctttgcaactaatt

SEQ ID NO: 3532 - DNA, 20 bp, Homo sapiens
  mature of SEQ ID 1325
ccccttcacaccctctgcat

SEQ ID NO: 3533 - DNA, 25 bp, Homo sapiens
  mature of SEQ ID 1326
gtccggaagctaccgagcgagtccg

SEQ ID NO: 3534 - DNA, 29 bp, Homo sapiens
  mature of SEQ ID 1327
agctttgcatatttgtaaggttcaagggt

SEQ ID NO: 3535 - DNA, 23 bp, Homo sapiens
  mature of SEQ ID 1328
caaatagtgggtctttgtgtgtt

SEQ ID NO: 3536 - DNA, 21 bp, Homo sapiens
  mature of SEQ ID 1329
gtgactgtcatccttctggtt

SEQ ID NO: 3537 - DNA, 23 bp, Homo sapiens
  mature of SEQ ID 1331
agtaaattgaagatacaaattat

SEQ ID NO: 3538 - DNA, 19 bp, Homo sapiens
  mature of SEQ ID 1332
ggggaagatagattcttgt

SEQ ID NO: 3539 - DNA, 31 bp, Homo sapiens
  mature of SEQ ID 1333
agatgaggagaatccagtcctccaaccagct

SEQ ID NO: 3540 - DNA, 29 bp, Homo sapiens
  mature of SEQ ID 1333
tctccagttggcttcttgtgattggccag

SEQ ID NO: 3541 - DNA, 31 bp, Homo sapiens
  mature of SEQ ID 1333
cagttggcttcttgtgattggccagaacttt

SEQ ID NO: 3542 - DNA, 21 bp, Homo sapiens
  mature of SEQ ID 1335
taatgacttctctaaagtatt

SEQ ID NO: 3543 - DNA, 21 bp, Homo sapiens
  mature of SEQ ID 1335
acagatagaggtagtaacatt

SEQ ID NO: 3544 - DNA, 23 bp, Homo sapiens
  mature of SEQ ID 1336
gccctatcccacctgcatcagag

SEQ ID NO: 3545 - DNA, 32 bp, Homo sapiens
  mature of SEQ ID 1338
gtagtttcctggaggtgccaagagaggttagc

SEQ ID NO: 3546 - DNA, 30 bp, Homo sapiens
  mature of SEQ ID 1338
gctgggtagtttcctggaggtgccaagaga

SEQ ID NO: 3547 - DNA, 19 bp, Homo sapiens
  mature of SEQ ID 1339
atttcatgtgacttttact

SEQ ID NO: 3548 - DNA, 25 bp, Homo sapiens
  mature of SEQ ID 1339
gggattatgacatagatctgaaggg

SEQ ID NO: 3549 - DNA, 32 bp, Homo sapiens
  mature of SEQ ID 1340
ttatgaatgggtggctgtaaaaacttgcctca

SEQ ID NO: 3550 - DNA, 30 bp, Homo sapiens
  mature of SEQ ID 1340
ttcatttatgaatgggtggctgtaaaaact

SEQ ID NO: 3551 - DNA, 25 bp, Homo sapiens
  mature of SEQ ID 1341
gatgccgggcgcccgccgcagccgc

SEQ ID NO: 3552 - DNA, 23 bp, Homo sapiens
  mature of SEQ ID 1341
aggctgcggcggacgccagcatc

SEQ ID NO: 3553 - DNA, 26 bp, Homo sapiens
  mature of SEQ ID 1342
gatcacactggactcagaggccagaa

SEQ ID NO: 3554 - DNA, 22 bp, Homo sapiens
  mature of SEQ ID 1342
cctgtccctggcactgtgcctt

SEQ ID NO: 3555 - DNA, 23 bp, Homo sapiens
  mature of SEQ ID 1343
gtcactatggcaggaaaagtaat

SEQ ID NO: 3556 - DNA, 29 bp, Homo sapiens
  mature of SEQ ID 1343
tgccacttcctgcaaacagcaagattgtc

SEQ ID NO: 3557 - DNA, 32 bp, Homo sapiens
  mature of SEQ ID 1343
acttcctgcaaacagcaagattgtcgctgtaa

SEQ ID NO: 3558 - DNA, 22 bp, Homo sapiens
  mature of SEQ ID 1344
ctgaaagtgatctttttgaaac

SEQ ID NO: 3559 - DNA, 20 bp, Homo sapiens
  mature of SEQ ID 1346
tggggagaggataccctgat

SEQ ID NO: 3560 - DNA, 19 bp, Homo sapiens
  mature of SEQ ID 1346
attctcttacacagatgcc

SEQ ID NO: 3561 - DNA, 23 bp, Homo sapiens
  mature of SEQ ID 1347
gcaatctgctcacccacttgttg

SEQ ID NO: 3562 - DNA, 19 bp, Homo sapiens
  mature of SEQ ID 1347
ctgggggtgtggggactga

SEQ ID NO: 3563 - DNA, 29 bp, Homo sapiens
  mature of SEQ ID 1349
tggtataaactactgaccactggggaatt

SEQ ID NO: 3564 - DNA, 21 bp, Homo sapiens
  mature of SEQ ID 1349
aacttctcccctgacttaggc

SEQ ID NO: 3565 - DNA, 28 bp, Homo sapiens
  mature of SEQ ID 1350
ttaaataaagggatagctctgctcagca

SEQ ID NO: 3566 - DNA, 20 bp, Homo sapiens
  mature of SEQ ID 1351
tgaggaatgttgctgtagct

SEQ ID NO: 3567 - DNA, 29 bp, Homo sapiens
  mature of SEQ ID 1352
gcaacagtaaatttcaaggctagttaaga

SEQ ID NO: 3568 - DNA, 22 bp, Homo sapiens
  mature of SEQ ID 1354
ctgcttttatttgtagcttccc

SEQ ID NO: 3569 - DNA, 29 bp, Homo sapiens
  mature of SEQ ID 1354
taaaaggattgtaaagttgacaaatataa

SEQ ID NO: 3570 - DNA, 32 bp, Homo sapiens
  mature of SEQ ID 1354
aggattgtaaagttgacaaatataagcaggga

SEQ ID NO: 3571 - DNA, 19 bp, Homo sapiens
  mature of SEQ ID 1355
gctttgcagacttgggtat

SEQ ID NO: 3572 - DNA, 25 bp, Homo sapiens
  mature of SEQ ID 1356
tgaatatgaaatctttgactgaagc

SEQ ID NO: 3573 - DNA, 32 bp, Homo sapiens
  mature of SEQ ID 1356
gtttgaccatgttctagtctgagctaattttg

SEQ ID NO: 3574 - DNA, 29 bp, Homo sapiens
  mature of SEQ ID 1360
ttaaaattgtaaattatgtctgtttaaga

SEQ ID NO: 3575 - DNA, 26 bp, Homo sapiens
  mature of SEQ ID 1360
cagtgttttttaaaacagaataacag

SEQ ID NO: 3576 - DNA, 22 bp, Homo sapiens
  mature of SEQ ID 1361
tatcagcaagactgaaatgaaa

SEQ ID NO: 3577 - DNA, 22 bp, Homo sapiens
  mature of SEQ ID 1362
gcttctggggtccctgagcccc

SEQ ID NO: 3578 - DNA, 29 bp, Homo sapiens
  mature of SEQ ID 1363
tcatcgccatctgcgcggtgtccagcctg

SEQ ID NO: 3579 - DNA, 29 bp, Homo sapiens
  mature of SEQ ID 1364
tagttcaatttaattactactttaaaatt

SEQ ID NO: 3580 - DNA, 32 bp, Homo sapiens
  mature of SEQ ID 1364
tcaatttaattactactttaaaattcaaagag

SEQ ID NO: 3581 - DNA, 22 bp, Homo sapiens
  mature of SEQ ID 1365
ctttccaatttgttcctagttt

SEQ ID NO: 3582 - DNA, 29 bp, Homo sapiens
  mature of SEQ ID 1365
aatagctggaaaaatgaacagattgttct

SEQ ID NO: 3583 - DNA, 28 bp, Homo sapiens
  mature of SEQ ID 1366
taatgagattccagagttaatgttttgt

SEQ ID NO: 3584 - DNA, 21 bp, Homo sapiens
  mature of SEQ ID 1367
gtggtgcacttaacttgtgga

SEQ ID NO: 3585 - DNA, 34 bp, Homo sapiens
  mature of SEQ ID 1367
tgaagatttgaataaagtgatgaagttgcattac

SEQ ID NO: 3586 - DNA, 31 bp, Homo sapiens
  mature of SEQ ID 1367
ctattttgaagatttgaataaagtgatgaag

SEQ ID NO: 3587 - DNA, 20 bp, Homo sapiens
  mature of SEQ ID 1367
tttttatactaaaaatgtag

SEQ ID NO: 3588 - DNA, 22 bp, Homo sapiens
  mature of SEQ ID 1368
gcaggtctgactgagttaaagg

SEQ ID NO: 3589 - DNA, 22 bp, Homo sapiens
  mature of SEQ ID 1368
tcctttgaagaaattttgattt

SEQ ID NO: 3590 - DNA, 30 bp, Homo sapiens
  mature of SEQ ID 1369
ttccatttttaaacctgtggagtgggagtg

SEQ ID NO: 3591 - DNA, 34 bp, Homo sapiens
  mature of SEQ ID 1369
taccctgctcacacagatggtggtgggaagaatc

SEQ ID NO: 3592 - DNA, 33 bp, Homo sapiens
  mature of SEQ ID 1370
cagtcagtgcctgcgccctccctccctccgccg

SEQ ID NO: 3593 - DNA, 30 bp, Homo sapiens
  mature of SEQ ID 1370
cggtggagggaaaggggaaaggagccattt

SEQ ID NO: 3594 - DNA, 32 bp, Homo sapiens
  mature of SEQ ID 1370
gagggaaaggggaaaggagccattttctgctg

SEQ ID NO: 3595 - DNA, 20 bp, Homo sapiens
  mature of SEQ ID 1371
tagtagccacttatagaaag

SEQ ID NO: 3596 - DNA, 24 bp, Homo sapiens
  mature of SEQ ID 1371
gcaattcttctaggagtggagcct

SEQ ID NO: 3597 - DNA, 20 bp, Homo sapiens
  mature of SEQ ID 1373
ttcaacaccccagccatgta

SEQ ID NO: 3598 - DNA, 20 bp, Homo sapiens
  mature of SEQ ID 1374
gttgttgaggtggttaccat

SEQ ID NO: 3599 - DNA, 29 bp, Homo sapiens
  mature of SEQ ID 1375
tggttgtgttggggcatgggagacaggtg

SEQ ID NO: 3600 - DNA, 33 bp, Homo sapiens
  mature of SEQ ID 1376
ggggcctgtcttctgagtccagctggcagcagg

SEQ ID NO: 3601 - DNA, 30 bp, Homo sapiens
  mature of SEQ ID 1377
ttaaagcatgccaaaaatctgtttgtacat

SEQ ID NO: 3602 - DNA, 34 bp, Homo sapiens
  mature of SEQ ID 1378
attgtaaaactaatagggctgttaaaaccagctt

SEQ ID NO: 3603 - DNA, 19 bp, Homo sapiens
  mature of SEQ ID 1379
tcactgcagcagttttata

SEQ ID NO: 3604 - DNA, 27 bp, Homo sapiens
  mature of SEQ ID 1381
gttttcatgaaatggaagcatctgctg

SEQ ID NO: 3605 - DNA, 34 bp, Homo sapiens
  mature of SEQ ID 1381
tcactaattaaaagagctttcatttatagaggat

SEQ ID NO: 3606 - DNA, 21 bp, Homo sapiens
  mature of SEQ ID 1382
aatgtcatctatgatcagttt

SEQ ID NO: 3607 - DNA, 25 bp, Homo sapiens
  mature of SEQ ID 1384
taaagttttagaatcaggaataaga

SEQ ID NO: 3608 - DNA, 21 bp, Homo sapiens
  mature of SEQ ID 1385
tctttggctggaggtttccat

SEQ ID NO: 3609 - DNA, 21 bp, Homo sapiens
  mature of SEQ ID 1386
aatcttatgaatatgcaaata

SEQ ID NO: 3610 - DNA, 19 bp, Homo sapiens
  mature of SEQ ID 1388
gttgggggccaaggcgtgc

SEQ ID NO: 3611 - DNA, 22 bp, Homo sapiens
  mature of SEQ ID 1389
tttatgaaacatttgtgtctaa

SEQ ID NO: 3612 - DNA, 21 bp, Homo sapiens
  mature of SEQ ID 1390
acacagcaagtctaataacag

SEQ ID NO: 3613 - DNA, 23 bp, Homo sapiens
  mature of SEQ ID 1390
aaattgctgaagtgggccgttcc

SEQ ID NO: 3614 - DNA, 21 bp, Homo sapiens
  mature of SEQ ID 1391
gaactggtgactcgaatcatt

SEQ ID NO: 3615 - DNA, 26 bp, Homo sapiens
  mature of SEQ ID 1391
atttttctctcctaggaatgccagaa

SEQ ID NO: 3616 - DNA, 20 bp, Homo sapiens
  mature of SEQ ID 1392
tttatagtgtcctctttatg

SEQ ID NO: 3617 - DNA, 20 bp, Homo sapiens
  mature of SEQ ID 1393
ctatttagttacattctgtg

SEQ ID NO: 3618 - DNA, 33 bp, Homo sapiens
  mature of SEQ ID 1395
gaggttactttaaagataagaagcagcatttgg

SEQ ID NO: 3619 - DNA, 31 bp, Homo sapiens
  mature of SEQ ID 1396
ctcagcaggtagatgatggctatgcggtgcc

SEQ ID NO: 3620 - DNA, 34 bp, Homo sapiens
  mature of SEQ ID 1396
aggtagatgatggctatgcggtgccagcctgcca

SEQ ID NO: 3621 - DNA, 21 bp, Homo sapiens
  mature of SEQ ID 1396
tggcaggaagatggcactggc

SEQ ID NO: 3622 - DNA, 33 bp, Homo sapiens
  mature of SEQ ID 1397
ttcagtgtaaagggtgttatgaaaatgtaaagt

SEQ ID NO: 3623 - DNA, 23 bp, Homo sapiens
  mature of SEQ ID 1398
tgtttggcaactggggtgaaggg

SEQ ID NO: 3624 - DNA, 25 bp, Homo sapiens
  mature of SEQ ID 1399
aggcagctttgactaatgtctggtg

SEQ ID NO: 3625 - DNA, 32 bp, Homo sapiens
  mature of SEQ ID 1399
atttctgtctagacaacaaatcaatatggtgc

SEQ ID NO: 3626 - DNA, 21 bp, Homo sapiens
  mature of SEQ ID 1402
gagttaatgttcccctggcat

SEQ ID NO: 3627 - DNA, 22 bp, Homo sapiens
  mature of SEQ ID 1403
tggggtttgtgctgaaattgcc

SEQ ID NO: 3628 - DNA, 33 bp, Homo sapiens
  mature of SEQ ID 1403
ggtaattcaaaacaaatttcaagctgtgacaat

SEQ ID NO: 3629 - DNA, 19 bp, Homo sapiens
  mature of SEQ ID 1404
ggtccctaagtgagttttg

SEQ ID NO: 3630 - DNA, 19 bp, Homo sapiens
  mature of SEQ ID 1404
aaaatcatttagactaatt

SEQ ID NO: 3631 - DNA, 24 bp, Homo sapiens
  mature of SEQ ID 1404
tgtgtaattgatttttaaatgaat

SEQ ID NO: 3632 - DNA, 29 bp, Homo sapiens
  mature of SEQ ID 1405
tcaggcccatttaacacaatctgtaccac

SEQ ID NO: 3633 - DNA, 32 bp, Homo sapiens
  mature of SEQ ID 1405
gcccatttaacacaatctgtaccactcaatga

SEQ ID NO: 3634 - DNA, 33 bp, Homo sapiens
  mature of SEQ ID 1406
agaacaaaaggtttaatatattacagagaaaca

SEQ ID NO: 3635 - DNA, 31 bp, Homo sapiens
  mature of SEQ ID 1406
agacaaagaacaaaaggtttaatatattaca

SEQ ID NO: 3636 - DNA, 19 bp, Homo sapiens
  mature of SEQ ID 1409
ttaattaatgcagattaaa

SEQ ID NO: 3637 - DNA, 26 bp, Homo sapiens
  mature of SEQ ID 1409
tcggattcaaatgtgttaatatagag

SEQ ID NO: 3638 - DNA, 23 bp, Homo sapiens
  mature of SEQ ID 1410
gtattgtgattagaaacaaagac

SEQ ID NO: 3639 - DNA, 19 bp, Homo sapiens
  mature of SEQ ID 1412
ctatttattttcgcagtaa

SEQ ID NO: 3640 - DNA, 20 bp, Homo sapiens
  mature of SEQ ID 1412
attgctgcttttacaaaagg

SEQ ID NO: 3641 - DNA, 29 bp, Homo sapiens
  mature of SEQ ID 1413
agtgggagtatatttaaaatgcaaatatt

SEQ ID NO: 3642 - DNA, 33 bp, Homo sapiens
  mature of SEQ ID 1414
tttattgaaagtgaattgttattatttcaggga

SEQ ID NO: 3643 - DNA, 24 bp, Homo sapiens
  mature of SEQ ID 1414
gaatatgctgattattttaatgaa

SEQ ID NO: 3644 - DNA, 19 bp, Homo sapiens
  mature of SEQ ID 1415
gtaaagttctaaggagacc

SEQ ID NO: 3645 - DNA, 23 bp, Homo sapiens
  mature of SEQ ID 1415
ggtccccacaaccacacacttcc

SEQ ID NO: 3646 - DNA, 23 bp, Homo sapiens
  mature of SEQ ID 1416
gccagcagcttctggtaagacat

SEQ ID NO: 3647 - DNA, 19 bp, Homo sapiens
  mature of SEQ ID 1417
tgctggtgcaggtgacaaa

SEQ ID NO: 3648 - DNA, 31 bp, Homo sapiens
  mature of SEQ ID 1419
gggagacattccacttataggaggcaaagag

SEQ ID NO: 3649 - DNA, 25 bp, Homo sapiens
  mature of SEQ ID 1419
gactttcggggatggattgtctcct

SEQ ID NO: 3650 - DNA, 33 bp, Homo sapiens
  mature of SEQ ID 1420
cagggactttgcaaataaacctccagatgccat

SEQ ID NO: 3651 - DNA, 29 bp, Homo sapiens
  mature of SEQ ID 1421
taaattgactggttctttcactgaagtga

SEQ ID NO: 3652 - DNA, 32 bp, Homo sapiens
  mature of SEQ ID 1421
ttgactggttctttcactgaagtgaccagtca

SEQ ID NO: 3653 - DNA, 21 bp, Homo sapiens
  mature of SEQ ID 1422
aaagggccttgccttcagtga

SEQ ID NO: 3654 - DNA, 30 bp, Homo sapiens
  mature of SEQ ID 1423
tattcattgttcagttctaaatccctaaag

SEQ ID NO: 3655 - DNA, 25 bp, Homo sapiens
  mature of SEQ ID 1425
tggtgctttgcaggaggcaagtgag

SEQ ID NO: 3656 - DNA, 21 bp, Homo sapiens
  mature of SEQ ID 1425
tctggttggcctttttgaaga

SEQ ID NO: 3657 - DNA, 23 bp, Homo sapiens
  mature of SEQ ID 1426
ggcccagaagatgaaaagctgaa

SEQ ID NO: 3658 - DNA, 21 bp, Homo sapiens
  mature of SEQ ID 1427
ttcttaataaacctcatgctg

SEQ ID NO: 3659 - DNA, 31 bp, Homo sapiens
  mature of SEQ ID 1427
ctaattttgtaattaacaatgaatcaaaaga

SEQ ID NO: 3660 - DNA, 23 bp, Homo sapiens
  mature of SEQ ID 1428
ctggcaggatggggcatgaatga

SEQ ID NO: 3661 - DNA, 30 bp, Homo sapiens
  mature of SEQ ID 1428
gtcaaaactggttttccctgccctaaccca

SEQ ID NO: 3662 - DNA, 26 bp, Homo sapiens
  mature of SEQ ID 1429
ctgctaataaactgcctgtagcttta

SEQ ID NO: 3663 - DNA, 34 bp, Homo sapiens
  mature of SEQ ID 1429
aatgcaggcaggttgtgattagaggtgagccagt

SEQ ID NO: 3664 - DNA, 31 bp, Homo sapiens
  mature of SEQ ID 1430
tgcccattagtatctgaaatgatgtaatggc

SEQ ID NO: 3665 - DNA, 23 bp, Homo sapiens
  mature of SEQ ID 1431
gtgagtgtagaattgataaagat

SEQ ID NO: 3666 - DNA, 33 bp, Homo sapiens
  mature of SEQ ID 1431
tcagtttctgtacaactgcgaaatcctcctggt

SEQ ID NO: 3667 - DNA, 34 bp, Homo sapiens
  mature of SEQ ID 1432
tatttggggaaaatatgttgcatgttctcctggc

SEQ ID NO: 3668 - DNA, 31 bp, Homo sapiens
  mature of SEQ ID 1432
cagtgttatttggggaaaatatgttgcatgt

SEQ ID NO: 3669 - DNA, 19 bp, Homo sapiens
  mature of SEQ ID 1432
aaagatatacatatgccca

SEQ ID NO: 3670 - DNA, 21 bp, Homo sapiens
  mature of SEQ ID 1433
gctttggacttgaataccccc

SEQ ID NO: 3671 - DNA, 31 bp, Homo sapiens
  mature of SEQ ID 1434
gctgagctaattttacccacaggagctgact

SEQ ID NO: 3672 - DNA, 29 bp, Homo sapiens
  mature of SEQ ID 1434
cagagctgagctaattttacccacaggag

SEQ ID NO: 3673 - DNA, 21 bp, Homo sapiens
  mature of SEQ ID 1434
tgcctggggtgagttttgcct

SEQ ID NO: 3674 - DNA, 19 bp, Homo sapiens
  mature of SEQ ID 1436
tgctgccagcctccagggc

SEQ ID NO: 3675 - DNA, 33 bp, Homo sapiens
  mature of SEQ ID 1438
taatcatgacgtgtgaataataaggggatggtt

SEQ ID NO: 3676 - DNA, 30 bp, Homo sapiens
  mature of SEQ ID 1438
attagtaatcatgacgtgtgaataataagg

SEQ ID NO: 3677 - DNA, 19 bp, Homo sapiens
  mature of SEQ ID 1438
gcaaagcatggatattaat

SEQ ID NO: 3678 - DNA, 21 bp, Homo sapiens
  mature of SEQ ID 1440
atttaaattaaatattgagaa

SEQ ID NO: 3679 - DNA, 28 bp, Homo sapiens
  mature of SEQ ID 1440
gaatattaattaacattgtttcaaagag

SEQ ID NO: 3680 - DNA, 22 bp, Homo sapiens
  mature of SEQ ID 1441
ttatggctttcttctcctgccc

SEQ ID NO: 3681 - DNA, 34 bp, Homo sapiens
  mature of SEQ ID 1441
ttgcagaaacaggctgggagaaaggggtctttgg

SEQ ID NO: 3682 - DNA, 33 bp, Homo sapiens
  mature of SEQ ID 1442
aagaggtaatgtagtcacagtgacaaagttaga

SEQ ID NO: 3683 - DNA, 35 bp, Homo sapiens
  mature of SEQ ID 1442
atgtagtcacagtgacaaagttagattacaaggca

SEQ ID NO: 3684 - DNA, 21 bp, Homo sapiens
  mature of SEQ ID 1445
ctgcacagttggaaatggagg

SEQ ID NO: 3685 - DNA, 28 bp, Homo sapiens
  mature of SEQ ID 1446
gctgggcactgggccaagcttacatttc

SEQ ID NO: 3686 - DNA, 22 bp, Homo sapiens
  mature of SEQ ID 1447
gtagttatagattctatttata

SEQ ID NO: 3687 - DNA, 30 bp, Homo sapiens
  mature of SEQ ID 1447
aagaggataatgtatatttacaactacagc

SEQ ID NO: 3688 - DNA, 31 bp, Homo sapiens
  mature of SEQ ID 1448
tgatggccgtgggatggcaaagtcatcttca

SEQ ID NO: 3689 - DNA, 34 bp, Homo sapiens
  mature of SEQ ID 1448
ccgtgggatggcaaagtcatcttcattagacgga

SEQ ID NO: 3690 - DNA, 33 bp, Homo sapiens
  mature of SEQ ID 1452
tattaggacacattcatacaagatacacaagag

SEQ ID NO: 3691 - DNA, 23 bp, Homo sapiens
  mature of SEQ ID 1453
ccttaataatttcatttggcttg

SEQ ID NO: 3692 - DNA, 32 bp, Homo sapiens
  mature of SEQ ID 1453
agtgaaaattgattacctattaagtgctgagt

SEQ ID NO: 3693 - DNA, 33 bp, Homo sapiens
  mature of SEQ ID 1454
ggcgctgtcggccggggcggccgccggcaactc

SEQ ID NO: 3694 - DNA, 35 bp, Homo sapiens
  mature of SEQ ID 1454
cggccggggcggccgccggcaactcgtccgtcttg

SEQ ID NO: 3695 - DNA, 31 bp, Homo sapiens
  mature of SEQ ID 1455
gttgataagatctaattatatgtttgcagct

SEQ ID NO: 3696 - DNA, 27 bp, Homo sapiens
  mature of SEQ ID 1457
gagtggtttacagcagcttttaatgta

SEQ ID NO: 3697 - DNA, 33 bp, Homo sapiens
  mature of SEQ ID 1458
catttgtctgtaattggagagcccctgcctatg

SEQ ID NO: 3698 - DNA, 26 bp, Homo sapiens
  mature of SEQ ID 1459
gcccttgaaataatgagctgtgatct

SEQ ID NO: 3699 - DNA, 30 bp, Homo sapiens
  mature of SEQ ID 1460
tagacttgcaaatgatggaacatttaatta

SEQ ID NO: 3700 - DNA, 32 bp, Homo sapiens
  mature of SEQ ID 1460
ttgcaaatgatggaacatttaattattccaaa

SEQ ID NO: 3701 - DNA, 21 bp, Homo sapiens
  mature of SEQ ID 1460
aatccatcatccttcagttta

SEQ ID NO: 3702 - DNA, 25 bp, Homo sapiens
  mature of SEQ ID 1461
taagcagctgtgtatatctttccct

SEQ ID NO: 3703 - DNA, 26 bp, Homo sapiens
  mature of SEQ ID 1462
aactgcagattgacctaattaatgtc

SEQ ID NO: 3704 - DNA, 25 bp, Homo sapiens
  mature of SEQ ID 1462
taattcactaatagcattggagagg

SEQ ID NO: 3705 - DNA, 21 bp, Homo sapiens
  mature of SEQ ID 1464
tgtacctgatcatcgccatct

SEQ ID NO: 3706 - DNA, 27 bp, Homo sapiens
  mature of SEQ ID 1465
tgggctctggagaacagtttttaatgg

SEQ ID NO: 3707 - DNA, 35 bp, Homo sapiens
  mature of SEQ ID 1465
attagtttcctgggctctggagaacagtttttaat

SEQ ID NO: 3708 - DNA, 35 bp, Homo sapiens
  mature of SEQ ID 1465
accatttgcaattagtttcctgggctctggagaac

SEQ ID NO: 3709 - DNA, 32 bp, Homo sapiens
  mature of SEQ ID 1467
gctggctgaagtcagaggctttgcatatcatg

SEQ ID NO: 3710 - DNA, 23 bp, Homo sapiens
  mature of SEQ ID 1467
ggcaatgaagaaggcttctgagg

SEQ ID NO: 3711 - DNA, 19 bp, Homo sapiens
  mature of SEQ ID 1468
tatttatgatgtgtcaaat

SEQ ID NO: 3712 - DNA, 30 bp, Homo sapiens
  mature of SEQ ID 1469
aggatcagcctcctaacttcttgataaatt

SEQ ID NO: 3713 - DNA, 32 bp, Homo sapiens
  mature of SEQ ID 1469
cagcctcctaacttcttgataaattagtttct

SEQ ID NO: 3714 - DNA, 21 bp, Homo sapiens
  mature of SEQ ID 1470
gttttgtttatttatgggatc

SEQ ID NO: 3715 - DNA, 22 bp, Homo sapiens
  mature of SEQ ID 1471
ctgaaggatactattgccagag

SEQ ID NO: 3716 - DNA, 31 bp, Homo sapiens
  mature of SEQ ID 1472
cgtttacattttgaaataaaatttatgattc

SEQ ID NO: 3717 - DNA, 29 bp, Homo sapiens
  mature of SEQ ID 1472
gtgacgtttacattttgaaataaaattta

SEQ ID NO: 3718 - DNA, 26 bp, Homo sapiens
  mature of SEQ ID 1472
gaaattgtaaattttattgttttaac

SEQ ID NO: 3719 - DNA, 36 bp, Homo sapiens
  mature of SEQ ID 1474
tgtggcattctcagtccatcttgcaagctgcatagc

SEQ ID NO: 3720 - DNA, 33 bp, Homo sapiens
  mature of SEQ ID 1474
agcccacctgtggcattctcagtccatcttgca

SEQ ID NO: 3721 - DNA, 22 bp, Homo sapiens
  mature of SEQ ID 1474
gaattcagaaatgccacccgct

SEQ ID NO: 3722 - DNA, 31 bp, Homo sapiens
  mature of SEQ ID 1475
taggacatgactcagtttcttaacacattgg

SEQ ID NO: 3723 - DNA, 29 bp, Homo sapiens
  mature of SEQ ID 1475
aatttaggacatgactcagtttcttaaca

SEQ ID NO: 3724 - DNA, 26 bp, Homo sapiens
  mature of SEQ ID 1476
tatctaaactttcagtctgaggttta

SEQ ID NO: 3725 - DNA, 20 bp, Homo sapiens
  mature of SEQ ID 1477
ctttggaagacagttctctt

SEQ ID NO: 3726 - DNA, 30 bp, Homo sapiens
  mature of SEQ ID 1478
atgcctaaacattctctctaatattaattt

SEQ ID NO: 3727 - DNA, 28 bp, Homo sapiens
  mature of SEQ ID 1478
atttggagttaattgcatggcaaatgaa

SEQ ID NO: 3728 - DNA, 33 bp, Homo sapiens
  mature of SEQ ID 1480
ctcagcatggagcgtgatgttgcataagtaaga

SEQ ID NO: 3729 - DNA, 35 bp, Homo sapiens
  mature of SEQ ID 1480
ggagcgtgatgttgcataagtaagaaaattgaatt

SEQ ID NO: 3730 - DNA, 30 bp, Homo sapiens
  mature of SEQ ID 1482
ggaagggcactgtctctctgattcccaggg

SEQ ID NO: 3731 - DNA, 28 bp, Homo sapiens
  mature of SEQ ID 1486
ggtttctaaaggctcagcaggggttaga

SEQ ID NO: 3732 - DNA, 26 bp, Homo sapiens
  mature of SEQ ID 1487
caatgggagccatgtgcaaagtttgc

SEQ ID NO: 3733 - DNA, 22 bp, Homo sapiens
  mature of SEQ ID 1488
acacttgaatcattaattttgt

SEQ ID NO: 3734 - DNA, 21 bp, Homo sapiens
  mature of SEQ ID 1489
tggagatgagtgacaagcctc

SEQ ID NO: 3735 - DNA, 32 bp, Homo sapiens
  mature of SEQ ID 1490
gctgtatgctcctcctgatttgaaatagatga

SEQ ID NO: 3736 - DNA, 29 bp, Homo sapiens
  mature of SEQ ID 1490
gtttgctgtatgctcctcctgatttgaaa

SEQ ID NO: 3737 - DNA, 28 bp, Homo sapiens
  mature of SEQ ID 1491
tgtgtacagtgtatattgtataatagac

SEQ ID NO: 3738 - DNA, 21 bp, Homo sapiens
  mature of SEQ ID 1493
gtaagcctgcctcagacagcc

SEQ ID NO: 3739 - DNA, 20 bp, Homo sapiens
  mature of SEQ ID 1494
gatactgatggcttctagga

SEQ ID NO: 3740 - DNA, 22 bp, Homo sapiens
  mature of SEQ ID 1494
ttataagtctgtggtcacagta

SEQ ID NO: 3741 - DNA, 30 bp, Homo sapiens
  mature of SEQ ID 1495
acaatggtttccagttaacacatggcacag

SEQ ID NO: 3742 - DNA, 30 bp, Homo sapiens
  mature of SEQ ID 1496
gtttgagctggaattaaatgtgcacagctg

SEQ ID NO: 3743 - DNA, 34 bp, Homo sapiens
  mature of SEQ ID 1496
ctgcaaattctttaattcttgttatctcttaaac

SEQ ID NO: 3744 - DNA, 31 bp, Homo sapiens
  mature of SEQ ID 1496
catctgctgcaaattctttaattcttgttat

SEQ ID NO: 3745 - DNA, 26 bp, Homo sapiens
  mature of SEQ ID 1497
tcatatttctgccaaatgtcgatcca

SEQ ID NO: 3746 - DNA, 22 bp, Homo sapiens
  mature of SEQ ID 1499
agacaagcagttccttttagat

SEQ ID NO: 3747 - DNA, 34 bp, Homo sapiens
  mature of SEQ ID 1499
ctggaactgtctcttgtaatttaatatgcaaaga

SEQ ID NO: 3748 - DNA, 31 bp, Homo sapiens
  mature of SEQ ID 1499
atccagctggaactgtctcttgtaatttaat

SEQ ID NO: 3749 - DNA, 33 bp, Homo sapiens
  mature of SEQ ID 1501
atgagtggctgtaaagtaaaatatattatgatt

SEQ ID NO: 3750 - DNA, 31 bp, Homo sapiens
  mature of SEQ ID 1501
tcagttatgagtggctgtaaagtaaaatata

SEQ ID NO: 3751 - DNA, 23 bp, Homo sapiens
  mature of SEQ ID 1502
atatagaatctagtttttaaaat

SEQ ID NO: 3752 - DNA, 24 bp, Homo sapiens
  mature of SEQ ID 1502
taaaaactgtgaactatgttttga

SEQ ID NO: 3753 - DNA, 31 bp, Homo sapiens
  mature of SEQ ID 1503
tgcctctccagtgcggccagagctcgcttcg

SEQ ID NO: 3754 - DNA, 33 bp, Homo sapiens
  mature of SEQ ID 1503
tccagtgcggccagagctcgcttcgcgcaccca

SEQ ID NO: 3755 - DNA, 24 bp, Homo sapiens
  mature of SEQ ID 1504
gtcttgggttctattgtactataa

SEQ ID NO: 3756 - DNA, 30 bp, Homo sapiens
  mature of SEQ ID 1504
gagctattatttatagaatatttaaagagc

SEQ ID NO: 3757 - DNA, 21 bp, Homo sapiens
  mature of SEQ ID 1506
atgatatctttattataccct

SEQ ID NO: 3758 - DNA, 19 bp, Homo sapiens
  mature of SEQ ID 1507
gatattatttcctgaacag

SEQ ID NO: 3759 - DNA, 25 bp, Homo sapiens
  mature of SEQ ID 1508
aataagacattcctgctaatttgcc

SEQ ID NO: 3760 - DNA, 22 bp, Homo sapiens
  mature of SEQ ID 1508
ggtctgtggcaactgttttgtt

SEQ ID NO: 3761 - DNA, 19 bp, Homo sapiens
  mature of SEQ ID 1510
tcatcttgcttcttcatgg

SEQ ID NO: 3762 - DNA, 22 bp, Homo sapiens
  mature of SEQ ID 1511
ttcagtcatgttgatggatgcc

SEQ ID NO: 3763 - DNA, 26 bp, Homo sapiens
  mature of SEQ ID 1512
atcccttcttgtattcccggtctgac

SEQ ID NO: 3764 - DNA, 20 bp, Homo sapiens
  mature of SEQ ID 1512
gcatgtccaccggggtgtgg

SEQ ID NO: 3765 - DNA, 28 bp, Homo sapiens
  mature of SEQ ID 1513
aacaagaaattgatggcattttcacctg

SEQ ID NO: 3766 - DNA, 33 bp, Homo sapiens
  mature of SEQ ID 1513
gaagaagaaataacatcaaactagtttgttcct

SEQ ID NO: 3767 - DNA, 31 bp, Homo sapiens
  mature of SEQ ID 1513
aaaatcgaagaagaaataacatcaaactagt

SEQ ID NO: 3768 - DNA, 32 bp, Homo sapiens
  mature of SEQ ID 1514
ggaaatgtaatgcagagtgactaagataatgt

SEQ ID NO: 3769 - DNA, 34 bp, Homo sapiens
  mature of SEQ ID 1515
gaaaataggacaatgaaacaagaattctgacttg

SEQ ID NO: 3770 - DNA, 35 bp, Homo sapiens
  mature of SEQ ID 1516
aagtcattttatgccacttgactcaaatcattcat

SEQ ID NO: 3771 - DNA, 33 bp, Homo sapiens
  mature of SEQ ID 1516
gcactttgaagtcattttatgccacttgactca

SEQ ID NO: 3772 - DNA, 26 bp, Homo sapiens
  mature of SEQ ID 1516
gaaaatttgttagttaaatgtcagct

SEQ ID NO: 3773 - DNA, 25 bp, Homo sapiens
  mature of SEQ ID 1520
ttttcacaacagctcaaaggcagat

SEQ ID NO: 3774 - DNA, 31 bp, Homo sapiens
  mature of SEQ ID 1521
tccactgttggctttagtcacggcggggatc

SEQ ID NO: 3775 - DNA, 30 bp, Homo sapiens
  mature of SEQ ID 1521
cgctaaaggagatctgcacgccgggcagag

SEQ ID NO: 3776 - DNA, 32 bp, Homo sapiens
  mature of SEQ ID 1521
aaggagatctgcacgccgggcagagtggaagt

SEQ ID NO: 3777 - DNA, 22 bp, Homo sapiens
  mature of SEQ ID 1522
gaggtctatttttacctactgt

SEQ ID NO: 3778 - DNA, 20 bp, Homo sapiens
  mature of SEQ ID 1522
tgttgggttgaatatatttt

SEQ ID NO: 3779 - DNA, 30 bp, Homo sapiens
  mature of SEQ ID 1524
caagtggtaaacaaataaaggatggaaatg

SEQ ID NO: 3780 - DNA, 32 bp, Homo sapiens
  mature of SEQ ID 1524
ggtaaacaaataaaggatggaaatgtcattct

SEQ ID NO: 3781 - DNA, 19 bp, Homo sapiens
  mature of SEQ ID 1525
ctgacatttactttcactc

SEQ ID NO: 3782 - DNA, 25 bp, Homo sapiens
  mature of SEQ ID 1527
ctaatgttttctgcagataatttga

SEQ ID NO: 3783 - DNA, 30 bp, Homo sapiens
  mature of SEQ ID 1528
caggctttgatccgaagtgggcgaataatt

SEQ ID NO: 3784 - DNA, 32 bp, Homo sapiens
  mature of SEQ ID 1528
tttgatccgaagtgggcgaataatttattgag

SEQ ID NO: 3785 - DNA, 30 bp, Homo sapiens
  mature of SEQ ID 1529
tcaattaatgacatatgcatatgtatgcca

SEQ ID NO: 3786 - DNA, 23 bp, Homo sapiens
  mature of SEQ ID 1531
gagtggctggctaatgagaggtt

SEQ ID NO: 3787 - DNA, 29 bp, Homo sapiens
  mature of SEQ ID 1532
tgatgtatagtatgcctgtattatagttt

SEQ ID NO: 3788 - DNA, 23 bp, Homo sapiens
  mature of SEQ ID 1532
attgtgaacttgtgtaatagtat

SEQ ID NO: 3789 - DNA, 23 bp, Homo sapiens
  mature of SEQ ID 1533
catagatgtgaatgtatagatgg

SEQ ID NO: 3790 - DNA, 31 bp, Homo sapiens
  mature of SEQ ID 1534
aggcctaaaaaattgatttttatggctcttc

SEQ ID NO: 3791 - DNA, 34 bp, Homo sapiens
  mature of SEQ ID 1534
aaaaaattgatttttatggctcttcttgtaattc

SEQ ID NO: 3792 - DNA, 21 bp, Homo sapiens
  mature of SEQ ID 1534
aggcacatgatattgatgtgg

SEQ ID NO: 3793 - DNA, 31 bp, Homo sapiens
  mature of SEQ ID 1535
ggggaaataaagcctagattggaaccttctg

SEQ ID NO: 3794 - DNA, 34 bp, Homo sapiens
  mature of SEQ ID 1535
ataaagcctagattggaaccttctgcccagcttc

SEQ ID NO: 3795 - DNA, 30 bp, Homo sapiens
  mature of SEQ ID 1537
gctgcaaaattgaaggtgtatttttataga

SEQ ID NO: 3796 - DNA, 20 bp, Homo sapiens
  mature of SEQ ID 1538
agagttacttacagatagct

SEQ ID NO: 3797 - DNA, 25 bp, Homo sapiens
  mature of SEQ ID 1539
tcaggacacattattcaaatgagga

SEQ ID NO: 3798 - DNA, 29 bp, Homo sapiens
  mature of SEQ ID 1540
agataacaaacacttctttaatcttctct

SEQ ID NO: 3799 - DNA, 25 bp, Homo sapiens
  mature of SEQ ID 1541
tcaatggccctaaaaatttctcatt

SEQ ID NO: 3800 - DNA, 30 bp, Homo sapiens
  mature of SEQ ID 1541
aatgagaaattttcagggctactgaacact

SEQ ID NO: 3801 - DNA, 24 bp, Homo sapiens
  mature of SEQ ID 1542
attatgacagccacattctgctgc

SEQ ID NO: 3802 - DNA, 31 bp, Homo sapiens
  mature of SEQ ID 1543
gtcctttaaatgctaaataataagttaaatg

SEQ ID NO: 3803 - DNA, 19 bp, Homo sapiens
  mature of SEQ ID 1544
ctgaaggacactattgcca

SEQ ID NO: 3804 - DNA, 33 bp, Homo sapiens
  mature of SEQ ID 1545
tgcagggcctggcctacaatactggagttaagg

SEQ ID NO: 3805 - DNA, 31 bp, Homo sapiens
  mature of SEQ ID 1545
tcagaatgcagggcctggcctacaatactgg

SEQ ID NO: 3806 - DNA, 30 bp, Homo sapiens
  mature of SEQ ID 1545
tcttaacttcttccaaggttaccaggtcag

SEQ ID NO: 3807 - DNA, 33 bp, Homo sapiens
  mature of SEQ ID 1545
acttcttccaaggttaccaggtcagtagcttga

SEQ ID NO: 3808 - DNA, 33 bp, Homo sapiens
  mature of SEQ ID 1547
cagggcaatttgcataaaaagtgatgacaaaga

SEQ ID NO: 3809 - DNA, 36 bp, Homo sapiens
  mature of SEQ ID 1549
aaagccagttaattttattagaacatttaatcacag

SEQ ID NO: 3810 - DNA, 34 bp, Homo sapiens
  mature of SEQ ID 1549
gtttgtagcaaagccagttaattttattagaaca

SEQ ID NO: 3811 - DNA, 31 bp, Homo sapiens
  mature of SEQ ID 1550
actactaattagaagccatttcctgctctct

SEQ ID NO: 3812 - DNA, 29 bp, Homo sapiens
  mature of SEQ ID 1550
ggacactactaattagaagccatttcctg

SEQ ID NO: 3813 - DNA, 22 bp, Homo sapiens
  mature of SEQ ID 1553
tccctctgtggaagaatgtgtg

SEQ ID NO: 3814 - DNA, 19 bp, Homo sapiens
  mature of SEQ ID 1553
ctaactgtgcaggggaaaa

SEQ ID NO: 3815 - DNA, 29 bp, Homo sapiens
  mature of SEQ ID 1554
tgtggcactgtctttataccgcatccgca

SEQ ID NO: 3816 - DNA, 32 bp, Homo sapiens
  mature of SEQ ID 1554
gcactgtctttataccgcatccgcaagccaga

SEQ ID NO: 3817 - DNA, 32 bp, Homo sapiens
  mature of SEQ ID 1554
tgacctgcagctgtggaaacaaggacatattt

SEQ ID NO: 3818 - DNA, 34 bp, Homo sapiens
  mature of SEQ ID 1554
cagctgtggaaacaaggacatattttattgtgcc

SEQ ID NO: 3819 - DNA, 26 bp, Homo sapiens
  mature of SEQ ID 1557
tcaggtccctaagtggcgatttgtgg

SEQ ID NO: 3820 - DNA, 19 bp, Homo sapiens
  mature of SEQ ID 1557
aaaccagttagtcaattcg

SEQ ID NO: 3821 - DNA, 30 bp, Homo sapiens
  mature of SEQ ID 1558
ttgtatatgcatttctatagagctcctcaa

SEQ ID NO: 3822 - DNA, 33 bp, Homo sapiens
  mature of SEQ ID 1558
tatgcatttctatagagctcctcaaaactaaga

SEQ ID NO: 3823 - DNA, 31 bp, Homo sapiens
  mature of SEQ ID 1558
tcttagtccagtgtagagcttttctccatgt

SEQ ID NO: 3824 - DNA, 33 bp, Homo sapiens
  mature of SEQ ID 1558
tccagtgtagagcttttctccatgtttatgcaa

SEQ ID NO: 3825 - DNA, 22 bp, Homo sapiens
  mature of SEQ ID 1559
tggctttgagatgaaggcgacg

SEQ ID NO: 3826 - DNA, 23 bp, Homo sapiens
  mature of SEQ ID 1560
gaagttatgggttcttttaacct

SEQ ID NO: 3827 - DNA, 29 bp, Homo sapiens
  mature of SEQ ID 1560
cgttatttaaaaacccaaatgactttttg

SEQ ID NO: 3828 - DNA, 33 bp, Homo sapiens
  mature of SEQ ID 1561
tagctgcctcagagtagaaaataaaactcaaca

SEQ ID NO: 3829 - DNA, 29 bp, Homo sapiens
  mature of SEQ ID 1562
atgaaatttgagaaagactttgactttga

SEQ ID NO: 3830 - DNA, 31 bp, Homo sapiens
  mature of SEQ ID 1562
aatttgagaaagactttgactttgaaagtgc

SEQ ID NO: 3831 - DNA, 26 bp, Homo sapiens
  mature of SEQ ID 1563
atcctgtcttcttttaatttcaaaga

SEQ ID NO: 3832 - DNA, 33 bp, Homo sapiens
  mature of SEQ ID 1564
aaacaaagagggtctgatgccaatcctggtgcc

SEQ ID NO: 3833 - DNA, 30 bp, Homo sapiens
  mature of SEQ ID 1564
gagctaaacaaagagggtctgatgccaatc

SEQ ID NO: 3834 - DNA, 31 bp, Homo sapiens
  mature of SEQ ID 1564
ggcaaccatctttggcattctctctgttctt

SEQ ID NO: 3835 - DNA, 30 bp, Homo sapiens
  mature of SEQ ID 1566
actcctgataacacttgctacatatcatgt

SEQ ID NO: 3836 - DNA, 33 bp, Homo sapiens
  mature of SEQ ID 1566
tgataacacttgctacatatcatgttttaattg

SEQ ID NO: 3837 - DNA, 19 bp, Homo sapiens
  mature of SEQ ID 1566
tttagtaaagtgtatcaaa

SEQ ID NO: 3838 - DNA, 25 bp, Homo sapiens
  mature of SEQ ID 1567
aaggaagctaaatttagcctagtaa

SEQ ID NO: 3839 - DNA, 23 bp, Homo sapiens
  mature of SEQ ID 1568
ggcctgtgattgggcagattttc

SEQ ID NO: 3840 - DNA, 30 bp, Homo sapiens
  mature of SEQ ID 1570
aaggctgcagtaaattcagaagtgccattt

SEQ ID NO: 3841 - DNA, 33 bp, Homo sapiens
  mature of SEQ ID 1570
tgcagtaaattcagaagtgccatttagtgaata

SEQ ID NO: 3842 - DNA, 34 bp, Homo sapiens
  mature of SEQ ID 1570
tattcatcatttctccttttatgagcaccttggc

SEQ ID NO: 3843 - DNA, 19 bp, Homo sapiens
  mature of SEQ ID 1571
gtttcaggttcctttgaac

SEQ ID NO: 3844 - DNA, 19 bp, Homo sapiens
  mature of SEQ ID 1571
tccagattttatgctaatt

SEQ ID NO: 3845 - DNA, 31 bp, Homo sapiens
  mature of SEQ ID 1572
cacattttgttgacttctgacattccacttt

SEQ ID NO: 3846 - DNA, 21 bp, Homo sapiens
  mature of SEQ ID 1572
taggaaagatctgtttatgta

SEQ ID NO: 3847 - DNA, 33 bp, Homo sapiens
  mature of SEQ ID 1573
gcttattcattcattatgcttaattaaaaacat

SEQ ID NO: 3848 - DNA, 21 bp, Homo sapiens
  mature of SEQ ID 1574
atccagttttgtattagaaat

SEQ ID NO: 3849 - DNA, 21 bp, Homo sapiens
  mature of SEQ ID 1575
atattgtcacttgtatattgt

SEQ ID NO: 3850 - DNA, 26 bp, Homo sapiens
  mature of SEQ ID 1576
gcactgagaccaatgagtcggacatc

SEQ ID NO: 3851 - DNA, 34 bp, Homo sapiens
  mature of SEQ ID 1576
gggtcatctcaatgtttcggatggccctggccac

SEQ ID NO: 3852 - DNA, 24 bp, Homo sapiens
  mature of SEQ ID 1578
aacaatggggccattgtgggagga

SEQ ID NO: 3853 - DNA, 20 bp, Homo sapiens
  mature of SEQ ID 1580
gcaggctgcaattccgtgat

SEQ ID NO: 3854 - DNA, 31 bp, Homo sapiens
  mature of SEQ ID 1580
gtcattggccatttgctgcctgcttcaccag

SEQ ID NO: 3855 - DNA, 32 bp, Homo sapiens
  mature of SEQ ID 1581
ccagccgccgccagtctccggcctcggatgtt

SEQ ID NO: 3856 - DNA, 31 bp, Homo sapiens
  mature of SEQ ID 1582
gttctataagattaattacataatgtttggg

SEQ ID NO: 3857 - DNA, 26 bp, Homo sapiens
  mature of SEQ ID 1583
gattcccttattaaagcatcaaattc

SEQ ID NO: 3858 - DNA, 20 bp, Homo sapiens
  mature of SEQ ID 1583
ggatgatggatgagggagac

SEQ ID NO: 3859 - DNA, 34 bp, Homo sapiens
  mature of SEQ ID 1584
cattttgtccctaatgcactgaaagtgttttaaa

SEQ ID NO: 3860 - DNA, 32 bp, Homo sapiens
  mature of SEQ ID 1585
ggctaatcactgacatggcccacagtgctttg

SEQ ID NO: 3861 - DNA, 28 bp, Homo sapiens
  mature of SEQ ID 1585
gtgtaccatgtttgcttgtaattagcac

SEQ ID NO: 3862 - DNA, 25 bp, Homo sapiens
  mature of SEQ ID 1586
ggaaaatggacgtgtgtctcatggt

SEQ ID NO: 3863 - DNA, 28 bp, Homo sapiens
  mature of SEQ ID 1586
cataaactctgaaccagagatcataccc

SEQ ID NO: 3864 - DNA, 33 bp, Homo sapiens
  mature of SEQ ID 1587
gatagatggctttgctggtcatgctataaataa

SEQ ID NO: 3865 - DNA, 23 bp, Homo sapiens
  mature of SEQ ID 1588
tctccccacgtgtaagctactcc

SEQ ID NO: 3866 - DNA, 21 bp, Homo sapiens
  mature of SEQ ID 1589
tagggcaagaggtgcagaatg

SEQ ID NO: 3867 - DNA, 24 bp, Homo sapiens
  mature of SEQ ID 1590
ctcatcaggaagcacttcaaagaa

SEQ ID NO: 3868 - DNA, 29 bp, Homo sapiens
  mature of SEQ ID 1591
gtccagcagaacaagccctccctgtctgt

SEQ ID NO: 3869 - DNA, 32 bp, Homo sapiens
  mature of SEQ ID 1591
gcctgttccacctggcaggctggactattgcc

SEQ ID NO: 3870 - DNA, 22 bp, Homo sapiens
  mature of SEQ ID 1592
ggcccggtgcccggcgggcggc

SEQ ID NO: 3871 - DNA, 25 bp, Homo sapiens
  mature of SEQ ID 1592
gtccggagcggccgatggggcccgt

SEQ ID NO: 3872 - DNA, 32 bp, Homo sapiens
  mature of SEQ ID 1593
cattgacatttcacataatctgactttgctta

SEQ ID NO: 3873 - DNA, 25 bp, Homo sapiens
  mature of SEQ ID 1594
ttaaattcttctacactgataaata

SEQ ID NO: 3874 - DNA, 31 bp, Homo sapiens
  mature of SEQ ID 1594
ggaattaattgttgtcagttgatgtatttaa

SEQ ID NO: 3875 - DNA, 21 bp, Homo sapiens
  mature of SEQ ID 1595
gttggagtgctggagatggta

SEQ ID NO: 3876 - DNA, 22 bp, Homo sapiens
  mature of SEQ ID 1597
gcatctattaattttcttactg

SEQ ID NO: 3877 - DNA, 27 bp, Homo sapiens
  mature of SEQ ID 1597
agacagttaagggagcctttgtggaaa

SEQ ID NO: 3878 - DNA, 31 bp, Homo sapiens
  mature of SEQ ID 1598
atagctttttagttttgctttgtcatctatt

SEQ ID NO: 3879 - DNA, 29 bp, Homo sapiens
  mature of SEQ ID 1598
acaaatagctttttagttttgctttgtca

SEQ ID NO: 3880 - DNA, 32 bp, Homo sapiens
  mature of SEQ ID 1601
ttccagctatttagtaactcttccaaaacact

SEQ ID NO: 3881 - DNA, 34 bp, Homo sapiens
  mature of SEQ ID 1601
tatttagtaactcttccaaaacactgtcagcacc

SEQ ID NO: 3882 - DNA, 23 bp, Homo sapiens
  mature of SEQ ID 1601
gcagggagtgggaaggaagtcta

SEQ ID NO: 3883 - DNA, 20 bp, Homo sapiens
  mature of SEQ ID 1602
gttggtgaataaaatttggg

SEQ ID NO: 3884 - DNA, 20 bp, Homo sapiens
  mature of SEQ ID 1603
gtggtttctaaatttagtca

SEQ ID NO: 3885 - DNA, 23 bp, Homo sapiens
  mature of SEQ ID 1604
gttctccttggaactcagagcac

SEQ ID NO: 3886 - DNA, 30 bp, Homo sapiens
  mature of SEQ ID 1604
tcaggaaatgagttttgctctgtttttcac

SEQ ID NO: 3887 - DNA, 32 bp, Homo sapiens
  mature of SEQ ID 1604
aaatgagttttgctctgtttttcacttggggg

SEQ ID NO: 3888 - DNA, 21 bp, Homo sapiens
  mature of SEQ ID 1605
aagtattttatggatcaatga

SEQ ID NO: 3889 - DNA, 26 bp, Homo sapiens
  mature of SEQ ID 1606
agctcttctgctgttgcaccatagtc

SEQ ID NO: 3890 - DNA, 32 bp, Homo sapiens
  mature of SEQ ID 1606
gtaacacggttgactgaaccacagccatgaaa

SEQ ID NO: 3891 - DNA, 23 bp, Homo sapiens
  mature of SEQ ID 1607
gtaatggcagcgtagatgacagc

SEQ ID NO: 3892 - DNA, 32 bp, Homo sapiens
  mature of SEQ ID 1608
atgattatttacttgcttataaataacactgt

SEQ ID NO: 3893 - DNA, 25 bp, Homo sapiens
  mature of SEQ ID 1608
aaatacagacagaataggcaactaa

SEQ ID NO: 3894 - DNA, 33 bp, Homo sapiens
  mature of SEQ ID 1609
cagggtttggggtgacctggaaggtcaactctt

SEQ ID NO: 3895 - DNA, 36 bp, Homo sapiens
  mature of SEQ ID 1609
ggggtgacctggaaggtcaactcttaagataattag

SEQ ID NO: 3896 - DNA, 30 bp, Homo sapiens
  mature of SEQ ID 1610
ggagctaaatatagaaagggctccctcctc

SEQ ID NO: 3897 - DNA, 32 bp, Homo sapiens
  mature of SEQ ID 1610
taaatatagaaagggctccctcctcccccagc

SEQ ID NO: 3898 - DNA, 20 bp, Homo sapiens
  mature of SEQ ID 1610
gctggaagtcagcctctttc

SEQ ID NO: 3899 - DNA, 31 bp, Homo sapiens
  mature of SEQ ID 1612
tattgtcttaacgtatttctggctattaggc

SEQ ID NO: 3900 - DNA, 23 bp, Homo sapiens
  mature of SEQ ID 1613
atttgtttagaagttactaaatt

SEQ ID NO: 3901 - DNA, 30 bp, Homo sapiens
  mature of SEQ ID 1613
ggaaatattaaaatagaattaatttaacta

SEQ ID NO: 3902 - DNA, 32 bp, Homo sapiens
  mature of SEQ ID 1613
tattaaaatagaattaatttaactaaacaaat

SEQ ID NO: 3903 - DNA, 34 bp, Homo sapiens
  mature of SEQ ID 1614
gatagaggctgaggtttgatgaccatttaatagc

SEQ ID NO: 3904 - DNA, 32 bp, Homo sapiens
  mature of SEQ ID 1614
ttgatgggatagaggctgaggtttgatgacca

SEQ ID NO: 3905 - DNA, 32 bp, Homo sapiens
  mature of SEQ ID 1614
taatggaaaactgatggcttttatctccccaa

SEQ ID NO: 3906 - DNA, 29 bp, Homo sapiens
  mature of SEQ ID 1614
gctataatggaaaactgatggcttttatc

SEQ ID NO: 3907 - DNA, 28 bp, Homo sapiens
  mature of SEQ ID 1615
atggaaacctatgcaactaaaactgact

SEQ ID NO: 3908 - DNA, 32 bp, Homo sapiens
  mature of SEQ ID 1615
atctttggccagatttagcataaacagactat

SEQ ID NO: 3909 - DNA, 30 bp, Homo sapiens
  mature of SEQ ID 1615
tgctcatctttggccagatttagcataaac

SEQ ID NO: 3910 - DNA, 29 bp, Homo sapiens
  mature of SEQ ID 1616
cagtatatggaaggaaatttttcaaatta

SEQ ID NO: 3911 - DNA, 32 bp, Homo sapiens
  mature of SEQ ID 1616
atatggaaggaaatttttcaaattaattttta

SEQ ID NO: 3912 - DNA, 22 bp, Homo sapiens
  mature of SEQ ID 1617
agtggacctgaagggttttgac

SEQ ID NO: 3913 - DNA, 19 bp, Homo sapiens
  mature of SEQ ID 1619
ctgggttacaagcttgttt

SEQ ID NO: 3914 - DNA, 23 bp, Homo sapiens
  mature of SEQ ID 1620
taatctccacagtatgtacttta

SEQ ID NO: 3915 - DNA, 30 bp, Homo sapiens
  mature of SEQ ID 1621
gccagcctggttttatttcactgtgtcaaa

SEQ ID NO: 3916 - DNA, 32 bp, Homo sapiens
  mature of SEQ ID 1621
cctggttttatttcactgtgtcaaattgtacc

SEQ ID NO: 3917 - DNA, 21 bp, Homo sapiens
  mature of SEQ ID 1621
gattcctaacgtcatgttggc

SEQ ID NO: 3918 - DNA, 33 bp, Homo sapiens
  mature of SEQ ID 1622
gttagcatatagtttctttgcacccactattta

SEQ ID NO: 3919 - DNA, 26 bp, Homo sapiens
  mature of SEQ ID 1623
atgcaattggaaaagatctgtttggt

SEQ ID NO: 3920 - DNA, 28 bp, Homo sapiens
  mature of SEQ ID 1624
ctaataaattctgagggctgacactgcc

SEQ ID NO: 3921 - DNA, 33 bp, Homo sapiens
  mature of SEQ ID 1624
ctttgccctcaatttcattgagatgggccattg

SEQ ID NO: 3922 - DNA, 31 bp, Homo sapiens
  mature of SEQ ID 1624
gctggtctttgccctcaatttcattgagatg

SEQ ID NO: 3923 - DNA, 29 bp, Homo sapiens
  mature of SEQ ID 1625
ctctctaacgagtttaagcacaataaggc

SEQ ID NO: 3924 - DNA, 31 bp, Homo sapiens
  mature of SEQ ID 1625
ctaacgagtttaagcacaataaggcctctga

SEQ ID NO: 3925 - DNA, 27 bp, Homo sapiens
  mature of SEQ ID 1626
tgtagtttctttttaacagtttaggta

SEQ ID NO: 3926 - DNA, 26 bp, Homo sapiens
  mature of SEQ ID 1627
tcagtgacttttattataaataggat

SEQ ID NO: 3927 - DNA, 21 bp, Homo sapiens
  mature of SEQ ID 1628
caaccttcaacttcaaagtaa

SEQ ID NO: 3928 - DNA, 27 bp, Homo sapiens
  mature of SEQ ID 1630
agttcctcatacttcaaagagccctaa

SEQ ID NO: 3929 - DNA, 21 bp, Homo sapiens
  mature of SEQ ID 1630
tgcagcagaacagtctggggc

SEQ ID NO: 3930 - DNA, 31 bp, Homo sapiens
  mature of SEQ ID 1633
gctgtttgtcttttcactgtcctgaatattt

SEQ ID NO: 3931 - DNA, 33 bp, Homo sapiens
  mature of SEQ ID 1634
gaatattttatttgaaagcaaatgctaaaagta

SEQ ID NO: 3932 - DNA, 21 bp, Homo sapiens
  mature of SEQ ID 1635
caggatcatgggattgaaccc

SEQ ID NO: 3933 - DNA, 33 bp, Homo sapiens
  mature of SEQ ID 1638
aggaatgatgaagtcagggcttctaataattgc

SEQ ID NO: 3934 - DNA, 32 bp, Homo sapiens
  mature of SEQ ID 1639
tgctttgttctttaatgttcctagcctggatc

SEQ ID NO: 3935 - DNA, 29 bp, Homo sapiens
  mature of SEQ ID 1639
gctgtgctttgttctttaatgttcctagc

SEQ ID NO: 3936 - DNA, 31 bp, Homo sapiens
  mature of SEQ ID 1639
cactttataacataaacggcaaagtaccatt

SEQ ID NO: 3937 - DNA, 33 bp, Homo sapiens
  mature of SEQ ID 1639
ataacataaacggcaaagtaccattttcacagc

SEQ ID NO: 3938 - DNA, 20 bp, Homo sapiens
  mature of SEQ ID 1640
tgacagttgtctgggtgaag

SEQ ID NO: 3939 - DNA, 19 bp, Homo sapiens
  mature of SEQ ID 1641
tctactgggtaaatacata

SEQ ID NO: 3940 - DNA, 23 bp, Homo sapiens
  mature of SEQ ID 1641
aaatccatgtaatttacccaaga

SEQ ID NO: 3941 - DNA, 23 bp, Homo sapiens
  mature of SEQ ID 1642
tggcctcaggctgtggtgcccag

SEQ ID NO: 3942 - DNA, 19 bp, Homo sapiens
  mature of SEQ ID 1644
tctggtgagggacagcctt

SEQ ID NO: 3943 - DNA, 34 bp, Homo sapiens
  mature of SEQ ID 1645
gcttgagaaactttgtttgccctagactcagcac

SEQ ID NO: 3944 - DNA, 20 bp, Homo sapiens
  mature of SEQ ID 1646
aagcttaaaataaaattgac

SEQ ID NO: 3945 - DNA, 32 bp, Homo sapiens
  mature of SEQ ID 1646
ttaatttgtcaaaaacatttctacagtttgtc

SEQ ID NO: 3946 - DNA, 20 bp, Homo sapiens
  mature of SEQ ID 1647
aattgtgggtttgtaggtta

SEQ ID NO: 3947 - DNA, 30 bp, Homo sapiens
  mature of SEQ ID 1647
acaaagttctttttctataaatcccaatta

SEQ ID NO: 3948 - DNA, 28 bp, Homo sapiens
  mature of SEQ ID 1648
gttggacgctccgggaaacaaagcaacc

SEQ ID NO: 3949 - DNA, 21 bp, Homo sapiens
  mature of SEQ ID 1648
gcagtttgccggaggcggtgt

SEQ ID NO: 3950 - DNA, 33 bp, Homo sapiens
  mature of SEQ ID 1649
aagtggtatctgttgtttaatcgaggacagatg

SEQ ID NO: 3951 - DNA, 31 bp, Homo sapiens
  mature of SEQ ID 1649
gtctgtaagtggtatctgttgtttaatcgag

SEQ ID NO: 3952 - DNA, 21 bp, Homo sapiens
  mature of SEQ ID 1650
cacagaacatttacttacagt

SEQ ID NO: 3953 - DNA, 24 bp, Homo sapiens
  mature of SEQ ID 1650
gaaaaggatgtcatgctgtaattt

SEQ ID NO: 3954 - DNA, 29 bp, Homo sapiens
  mature of SEQ ID 1651
gttttctgctttgggaatgttaccaagac

SEQ ID NO: 3955 - DNA, 25 bp, Homo sapiens
  mature of SEQ ID 1652
gtcgcaggagaaatcttttaatttg

SEQ ID NO: 3956 - DNA, 29 bp, Homo sapiens
  mature of SEQ ID 1653
ttattccagggagactctgtaatagatac

SEQ ID NO: 3957 - DNA, 24 bp, Homo sapiens
  mature of SEQ ID 1653
caatctgtaagctattacagtttt

SEQ ID NO: 3958 - DNA, 30 bp, Homo sapiens
  mature of SEQ ID 1655
ccatcaaaaatgcagctctccattgattct

SEQ ID NO: 3959 - DNA, 33 bp, Homo sapiens
  mature of SEQ ID 1656
gcctgatgggagcaggaggcggtgagggggcgg

SEQ ID NO: 3960 - DNA, 30 bp, Homo sapiens
  mature of SEQ ID 1656
ggttggcctgatgggagcaggaggcggtga

SEQ ID NO: 3961 - DNA, 26 bp, Homo sapiens
  mature of SEQ ID 1657
tgagcgtaacaccaggagagcagcca

SEQ ID NO: 3962 - DNA, 26 bp, Homo sapiens
  mature of SEQ ID 1657
cttgagctgcttttattgtttgtcta

SEQ ID NO: 3963 - DNA, 21 bp, Homo sapiens
  mature of SEQ ID 1658
ataaagtaagacatttttagg

SEQ ID NO: 3964 - DNA, 33 bp, Homo sapiens
  mature of SEQ ID 1659
aaaccatgaatcatttcataacttctgaaattg

SEQ ID NO: 3965 - DNA, 20 bp, Homo sapiens
  mature of SEQ ID 1660
tcgtgcgtgtgtgggcagga

SEQ ID NO: 3966 - DNA, 34 bp, Homo sapiens
  mature of SEQ ID 1661
attatgttggtttgaaaggaggaaatagcaaggt

SEQ ID NO: 3967 - DNA, 30 bp, Homo sapiens
  mature of SEQ ID 1661
gccttgctgtatttcttataccatttatta

SEQ ID NO: 3968 - DNA, 33 bp, Homo sapiens
  mature of SEQ ID 1661
gctgtatttcttataccatttattaaaaagctg

SEQ ID NO: 3969 - DNA, 21 bp, Homo sapiens
  mature of SEQ ID 1664
tgtttggaattgaagacaagg

SEQ ID NO: 3970 - DNA, 26 bp, Homo sapiens
  mature of SEQ ID 1665
agcaagctggggagcccagataaata

SEQ ID NO: 3971 - DNA, 20 bp, Homo sapiens
  mature of SEQ ID 1666
gagggccaaattctactttc

SEQ ID NO: 3972 - DNA, 24 bp, Homo sapiens
  mature of SEQ ID 1666
tttgaaattgtcagagaaactgat

SEQ ID NO: 3973 - DNA, 27 bp, Homo sapiens
  mature of SEQ ID 1667
cgcgcggagaggctcttaaagggccag

SEQ ID NO: 3974 - DNA, 32 bp, Homo sapiens
  mature of SEQ ID 1667
ataaaattttaatggtctctctggctgatccg

SEQ ID NO: 3975 - DNA, 35 bp, Homo sapiens
  mature of SEQ ID 1667
ttcattctgcataaaattttaatggtctctctggc

SEQ ID NO: 3976 - DNA, 35 bp, Homo sapiens
  mature of SEQ ID 1667
ctggcccattttcattctgcataaaattttaatgg

SEQ ID NO: 3977 - DNA, 19 bp, Homo sapiens
  mature of SEQ ID 1669
tgttttcttggactctgtt

SEQ ID NO: 3978 - DNA, 19 bp, Homo sapiens
  mature of SEQ ID 1669
ctaatttaattaaaaacat

SEQ ID NO: 3979 - DNA, 19 bp, Homo sapiens
  mature of SEQ ID 1670
tgatttataaaaacctgaa

SEQ ID NO: 3980 - DNA, 21 bp, Homo sapiens
  mature of SEQ ID 1674
ttgctgatcctgtggctgtgg

SEQ ID NO: 3981 - DNA, 34 bp, Homo sapiens
  mature of SEQ ID 1675
cataatggccagccagtgtgaaactgtgcaaatt

SEQ ID NO: 3982 - DNA, 25 bp, Homo sapiens
  mature of SEQ ID 1677
gtaattataatagagtttaatgaag

SEQ ID NO: 3983 - DNA, 26 bp, Homo sapiens
  mature of SEQ ID 1679
ctaatctggaaaaatgattcaatgac

SEQ ID NO: 3984 - DNA, 31 bp, Homo sapiens
  mature of SEQ ID 1679
ttaatgagctgctgtttcttttgacatttgg

SEQ ID NO: 3985 - DNA, 29 bp, Homo sapiens
  mature of SEQ ID 1679
ggttttaatgagctgctgtttcttttgac

SEQ ID NO: 3986 - DNA, 19 bp, Homo sapiens
  mature of SEQ ID 1681
atccttggacaggatttat

SEQ ID NO: 3987 - DNA, 24 bp, Homo sapiens
  mature of SEQ ID 1681
atagatcctgttatgtggaaagag

SEQ ID NO: 3988 - DNA, 22 bp, Homo sapiens
  mature of SEQ ID 1682
tgtgtttattctagcactgtta

SEQ ID NO: 3989 - DNA, 23 bp, Homo sapiens
  mature of SEQ ID 1683
ggcgctgcaggacacctgcccca

SEQ ID NO: 3990 - DNA, 24 bp, Homo sapiens
  mature of SEQ ID 1684
cacaaattaaatgcatgcttaaag

SEQ ID NO: 3991 - DNA, 21 bp, Homo sapiens
  mature of SEQ ID 1686
ataaaaagtttaccacaatca

SEQ ID NO: 3992 - DNA, 21 bp, Homo sapiens
  mature of SEQ ID 1686
aagtacctttaaataaaatca

SEQ ID NO: 3993 - DNA, 29 bp, Homo sapiens
  mature of SEQ ID 1688
gctatggattggcatggggtctgcagctc

SEQ ID NO: 3994 - DNA, 26 bp, Homo sapiens
  mature of SEQ ID 1688
cacagacagctgcaattcatgggcga

SEQ ID NO: 3995 - DNA, 28 bp, Homo sapiens
  mature of SEQ ID 1689
agagattgcatcagagccatcagcttca

SEQ ID NO: 3996 - DNA, 21 bp, Homo sapiens
  mature of SEQ ID 1690
caagcttacactcactgtctg

SEQ ID NO: 3997 - DNA, 30 bp, Homo sapiens
  mature of SEQ ID 1691
gcattgctattaaaatatttgtgcatgact

SEQ ID NO: 3998 - DNA, 21 bp, Homo sapiens
  mature of SEQ ID 1692
tgaattgtcaaaaagaattat

SEQ ID NO: 3999 - DNA, 30 bp, Homo sapiens
  mature of SEQ ID 1692
ataatgaataaatcaatcaatgaggcaagt

SEQ ID NO: 4000 - DNA, 33 bp, Homo sapiens
  mature of SEQ ID 1692
gaataaatcaatcaatgaggcaagttaaacttc

SEQ ID NO: 4001 - DNA, 21 bp, Homo sapiens
  mature of SEQ ID 1693
caggcattgcctggctcagag

SEQ ID NO: 4002 - DNA, 31 bp, Homo sapiens
  mature of SEQ ID 1693
gttaacaaagtgggctgaggggtgaagcctg

SEQ ID NO: 4003 - DNA, 29 bp, Homo sapiens
  mature of SEQ ID 1693
ctgagttaacaaagtgggctgaggggtga

SEQ ID NO: 4004 - DNA, 29 bp, Homo sapiens
  mature of SEQ ID 1611
aagtgaaagggacacaatcgattactacg

SEQ ID NO: 4005 - DNA, 48 bp, Artificial
  oligonucleotide derived from SEQ ID 77
ttgtaatacgactcaatggtctagacatttcactgttttgtcaacaaa

SEQ ID NO: 4006 - DNA, 37 bp, Artificial
  oligonucleotide derived from SEQ ID 139
ttgtaatacgactcagctggctccatgctccagtggg

SEQ ID NO: 4007 - DNA, 49 bp, Artificial
  oligonucleotide derived from SEQ ID 223
ttgtaatacgactcaatgggaggttttgctatcaagaaatctaatgagg

SEQ ID NO: 4008 - DNA, 46 bp, Artificial
  oligonucleotide derived from SEQ ID 328
ttgtaatacgactcaagtgcccgctcctccgacctccctgcgcacc

SEQ ID NO: 4009 - DNA, 48 bp, Artificial
  oligonucleotide derived from SEQ ID 328
ttgtaatacgactcagggtgggcagtgcccgctcctccgacctccctg

SEQ ID NO: 4010 - DNA, 49 bp, Artificial
  oligonucleotide derived from SEQ ID 728
ttgtaatacgactcactgccctccaagaaataaattacccgcaattact

SEQ ID NO: 4011 - DNA, 46 bp, Artificial
  oligonucleotide derived from SEQ ID 832
ttgtaatacgactcagacattcagagcactgggcagaaatcacatg

SEQ ID NO: 4012 - DNA, 48 bp, Artificial
  oligonucleotide derived from SEQ ID 832
ttgtaatacgactcattcactttgacattcagagcactgggcagaaat

SEQ ID NO: 4013 - DNA, 40 bp, Artificial
  oligonucleotide derived from SEQ ID 832
ttgtaatacgactcatagttactcccgccgtttacccgtg

SEQ ID NO: 4014 - DNA, 43 bp, Artificial
  oligonucleotide derived from SEQ ID 858
ttgtaatacgactcacacagacctggaaccttcaaaagcagta

SEQ ID NO: 4015 - DNA, 38 bp, Artificial
  oligonucleotide derived from SEQ ID 951
ttgtaatacgactcatttaagtaccaaatttgtcactc

SEQ ID NO: 4016 - DNA, 36 bp, Artificial
  oligonucleotide derived from SEQ ID 963
ttgtaatacgactcaccctcctttccccacctcagt

SEQ ID NO: 4017 - DNA, 48 bp, Artificial
  oligonucleotide derived from SEQ ID 1083
ttgtaatacgactcaacctgccaggaaggtgggggcgtggcagagggg

SEQ ID NO: 4018 - DNA, 35 bp, Artificial
  oligonucleotide derived from SEQ ID 1173
ttgtaatacgactcaagggctcccccacccctaag

SEQ ID NO: 4019 - DNA, 47 bp, Artificial
  oligonucleotide derived from SEQ ID 1205
ttgtaatacgactcaaattgcaaatatgcatttaaatttaataatac

SEQ ID NO: 4020 - DNA, 49 bp, Artificial
  oligonucleotide derived from SEQ ID 1429
ttgtaatacgactcaactggctcacctctaatcacaacctgcctgcatt

SEQ ID NO: 4021 - DNA, 44 bp, Artificial
  oligonucleotide derived from SEQ ID 1611
ttgtaatacgactcattcactttccctgtgttagctaatgatgc

SEQ ID NO: 4022 - DNA, 37 bp, Artificial
  oligonucleotide derived from SEQ ID 1617
ttgtaatacgactcagtcaaaacccttcaggtccact

SEQ ID NO: 4023 - DNA, 46 bp, Artificial
  oligonucleotide derived from SEQ ID 1649
ttgtaatacgactcactcgattaaacaacagataccacttacagac

SEQ ID NO: 4024 - DNA, 44 bp, Artificial
  oligonucleotide derived from SEQ ID 1688
ttgtaatacgactcagagctgcagaccccatgccaatccatagc

SEQ ID NO: 4025 - DNA, 46 bp, Artificial
  oligonucleotide derived from ath-mir156a
ttgtaatacgactcattgcctttgtgtgctcactctcttctgtcag

SEQ ID NO: 4026 - DNA, 46 bp, Artificial
  oligonucleotide derived from ath-mir156a
ttgtaatacgactcatgcaaattgcctttgtgtgctcactctcttc

SEQ ID NO: 4027 - DNA, 46 bp, Artificial
  oligonucleotide derived from ath-mir156a
ttgtaatacgactcagagcagtgagcacgcaagagaagcaagtgca

SEQ ID NO: 4028 - DNA, 50 bp, Artificial
  oligonucleotide derived from ath-mir156a
ttgtaatacgactcactgacagaaagagcagtgagcacgcaagagaagca

SEQ ID NO: 4029 - DNA, 50 bp, Artificial
  oligonucleotide derived from ath-mir157a
ttgtaatacgactcatctcatcatctgtgctctctatcttctgtcaacac

SEQ ID NO: 4030 - DNA, 50 bp, Artificial
  oligonucleotide derived from ath-mir157a
ttgtaatacgactcaccgaattgtatctcatcatctgtgctctctatctt

SEQ ID NO: 4031 - DNA, 42 bp, Artificial
  oligonucleotide derived from ath-mir157a
ttgtaatacgactcactccgaattgtatctcatcatctgtgc

SEQ ID NO: 4032 - DNA, 50 bp, Artificial
  oligonucleotide derived from ath-mir157a
ttgtaatacgactcaaggctagagagcacaaaggagtaagatgcaaagaa

SEQ ID NO: 4033 - DNA, 50 bp, Artificial
  oligonucleotide derived from ath-mir157a
ttgtaatacgactcatgatgacagaaggctagagagcacaaaggagtaag

SEQ ID NO: 4034 - DNA, 55 bp, Artificial
  oligonucleotide derived from TRNA MUSTRP2
ttgtaatacgactcatcgcacccaaagcgagaatcatacccctagaccaacgagc

SEQ ID NO: 4035 - DNA, 74 bp, Homo sapiens
tttatattgtgctttaattttttaaaaagtattctttattcatatgtatagaatgcttaaaatagcactgtaga

SEQ ID NO: 4036 - DNA, 73 bp, Homo sapiens
tttgtgttgaggttttgtggttttaaaaaagtcaaccagatttatttttaaattaacccagcccaacatcaaa

SEQ ID NO: 4037 - DNA, 73 bp, Homo sapiens
aaagttacaggaatatttggaactagatttttcctcctccctggagacgagtttaattcaagcctgtggcttt

SEQ ID NO: 4038 - DNA, 79 bp, Homo sapiens
gaggctgtggtgggcttgaggggagggagggagtcgggcgtggtctgaatctctttgctgagcccagctagttggcctc

SEQ ID NO: 4039 - DNA, 78 bp, Homo sapiens
taatgtattttcaacctacatgtcactttaatagcttggttatataactgctgtagtgataattaggttaacacattg

SEQ ID NO: 4040 - DNA, 88 bp, Homo sapiens
tgcttggcaggtgggcctactcagacgcactgactgttgtttcagcactgacagggaacatacatcatgcaggcccattatgccagca

SEQ ID NO: 4041 - DNA, 77 bp, Homo sapiens
cccaacgctcgggcctgactgctcaggaggggcttatgtaaccttaacctggtccctccgcacaggagagcaatggg

SEQ ID NO: 4042 - DNA, 86 bp, Homo sapiens
aatattagtactgcacccaccatacagtgcttgcttaacaaaagtagacattacattagtggaaattgaagtgtagtaatagtttt

SEQ ID NO: 4043 - DNA, 72 bp, Homo sapiens
tggtcagctctccctggggtccagcagctttggaggactgagctgctgtgaccggagaacacgagctgggca

SEQ ID NO: 4044 - DNA, 84 bp, Homo sapiens
cagagggtcttcagaagcccccctgggagggaggggaggatgagcacgcccagctcccctccagggtgtgacttggcccctctg

SEQ ID NO: 4045 - DNA, 80 bp, Homo sapiens
tcttgtggatgagaatcaaagctggtacctcaatgaaaatatcaaacatttctgcaccaaccctgattcagttgacaaga

SEQ ID NO: 4046 - DNA, 65 bp, Homo sapiens
atggatgagtcgtcaattttgataagatccatgactggtatcataatttgcagtgattcatctgt

SEQ ID NO: 4047 - DNA, 76 bp, Homo sapiens
aggtggtttaaatttgagcgtgcaggatttagatgttttatttttatatctgtctccgacactcccagagccacct

SEQ ID NO: 4048 - DNA, 73 bp, Homo sapiens
ggaaggtatctcgcctattagagtgcttaatgtgctcaatatgcacattaattctcttggcaagaatcttgcc

SEQ ID NO: 4049 - DNA, 87 bp, Homo sapiens
gccatttgcacaggcccaagtggatttgtggagaggagtttcctcctctacccaagaaatggcttactatctgacagtgccagtggc

SEQ ID NO: 4050 - DNA, 84 bp, Homo sapiens
gacaatgcactctgtgatcttgacattctgtaaatcttcactaccagtgatgactggtgtgttatgtgatcaagagtagcagtc

SEQ ID NO: 4051 - DNA, 87 bp, Homo sapiens
tgttataaggggtctcttcagtgtctttttggtcatatgaattttatttgcccagtagaacatgactgatgaggctctgaatagtca

SEQ ID NO: 4052 - DNA, 78 bp, Homo sapiens
tccagccttgctatctcgggttgcatatgctgggcatgtagggaatgctccaagcatctgccagaagcggggtgggga

SEQ ID NO: 4053 - DNA, 61 bp, Homo sapiens
aacagaaaaaaaaaaaagaaacacctggcaaagttggagaagccagttgtcattttctgtt

SEQ ID NO: 4054 - DNA, 66 bp, Homo sapiens
tatttttgttgttttatttttaatgaataagagatacttatattcattaaaattagaaaaaagata

SEQ ID NO: 4055 - DNA, 87 bp, Homo sapiens
gtgagtgacataccaaatgacccagcaagtgtttgactgagataagttttaacacttctgctaaaaaattgaaaaactgtcacttcc

SEQ ID NO: 4056 - DNA, 87 bp, Homo sapiens
ctggccacaaaataattacttacacttcctgatgcctgaatctgttagatatagcagcaagaagtgtactttgtttttgtaagtcag

SEQ ID NO: 4057 - DNA, 83 bp, Homo sapiens
tctctgccaccctgggaaaatgtctgttttcatagtgaggtctctcaaaatgatagcaaactaatcagcagaggttcttgaga

SEQ ID NO: 4058 - DNA, 69 bp, Homo sapiens
gggctggaaaaggggcgcggtgagctagggcggcgataccgctgccaccactgccgccggctccggccc

SEQ ID NO: 4059 - DNA, 81 bp, Homo sapiens
tccccagctgggctttggcatcctccatggaaatgatattattttttattttagcattgatgctgaggtccaccttgggga

SEQ ID NO: 4060 - DNA, 90 bp, Homo sapiens
tcatttcagggagtgggaggaaatgagttgtttacagaatgttcttgagttttaaacatttttctcctaatttttcccttttcaaaatga

SEQ ID NO: 4061 - DNA, 69 bp, Homo sapiens
gggagtgacatgtcccctgagctccaggccagtcctcagcaggcctgggagctgggcgctgctgcttcc

SEQ ID NO: 4062 - DNA, 75 bp, Homo sapiens
ttttatcctgtgaggtaggggttagttatctgggttattatccatgctggctgaatcagatttccagaggtggga

SEQ ID NO: 4063 - DNA, 86 bp, Homo sapiens
ttcaatgtagaggacatatttcttcctgtaaacccagactactttgccagtttgctgacctttatagtgtcctcatacaacctgaa

SEQ ID NO: 4064 - DNA, 68 bp, Homo sapiens
atcttgccagtctccaaatcaatctgaatggtatcattcaccttgatgaggggatcagggtagcagat

SEQ ID NO: 4065 - DNA, 89 bp, Homo sapiens
ctcctaaaatgtctgcaaaactaacagccctcccctgaagaatgttccattcttcaggagctgttcttaggactgtcaaattagaggag

SEQ ID NO: 4066 - DNA, 80 bp, Homo sapiens
tcatacaaaaatataaagggtaaatagaatctttgttgataaaatatgaggtagcatggattcacccctttattgtctga

SEQ ID NO: 4067 - DNA, 82 bp, Homo sapiens
tttttggatcaaatagcatgaggggagaggaaaccattaaaagttggggctcctactctcctttgctttgtaaattcaaaag

SEQ ID NO: 4068 - DNA, 77 bp, Homo sapiens
gaacatgacggattatgtattcactacatctgctgaatcagctgtgtctgtgcagtgaataccacatcctcattttc

SEQ ID NO: 4069 - DNA, 78 bp, Homo sapiens
ttgggcttaaaattttatattgcacttttttaagagtctggcactgcactgcaaaacaggcaatgtaaaatagcttgg

SEQ ID NO: 4070 - DNA, 79 bp, Homo sapiens
gctgtatttcccaacttggagattttgcaagttattaataaactttgcaatatttaccaggtgtttggttaacgcatgc

SEQ ID NO: 4071 - DNA, 72 bp, Homo sapiens
gtttattcagtggttgatttcctgggttataattgactgactatgaataaatgtttcagctattgagtaaac

SEQ ID NO: 4072 - DNA, 71 bp, Homo sapiens
ctccctaagagaccttgcctctgagcatgtcagctgaaaagatggcagagttcagagaaaggtgatgggag

SEQ ID NO: 4073 - DNA, 64 bp, Homo sapiens
agcctgggaactggccgggagttgggggctgggagctcgcccccgggccgagccgggtcaggct

SEQ ID NO: 4074 - DNA, 80 bp, Homo sapiens
gcacatttgcatgaggaactctggctggatgaggagaaaataacttcaaggtcattaccagggtttatgctcgactgtgc

SEQ ID NO: 4075 - DNA, 88 bp, Homo sapiens
tggttttgaaaatggtgatattggtgaatctgagtagaataatccactttatgtccactcaatttatattgtcccttttcaatatcca

SEQ ID NO: 4076 - DNA, 61 bp, Homo sapiens
agcagcagcagcgcgttgagcccggccacgtagagcgccagcccggtgcggccctgcaggc

SEQ ID NO: 4077 - DNA, 76 bp, Homo sapiens
gctttccatttggattgttgaggggccagctctggcaatttggggttagaattggtccatggaaaaagtggagagt

SEQ ID NO: 4078 - DNA, 81 bp, Homo sapiens
tctgcattaaataagtcaaaacacagtgcgcaaaatttggaaggattccttgagcactgcaaggacggagttagatgtaga

SEQ ID NO: 4079 - DNA, 76 bp, Homo sapiens
cagaatttttatgtaaagtcttatcatacagtattatgatctcagggatattttgtgatatttacagagtcttctg

SEQ ID NO: 4080 - DNA, 60 bp, Homo sapiens
agtggttcctgaatatttctgtgattaccaggcaatttgcataaatattcaggcttcact

SEQ ID NO: 4081 - DNA, 71 bp, Homo sapiens
tagagcaaattgttagaatcagcatttataattgagtttcaactaaatgctttgttttataatttgctgtg

SEQ ID NO: 4082 - DNA, 73 bp, Homo sapiens
tcctccccatctttctttctttctcctggggctcctcggaccacccaggagccggagttgaggtgggggcgga

SEQ ID NO: 4083 - DNA, 90 bp, Homo sapiens
tgtagcaaatcccatccatctgtttggctgctcttgcctcagtgacagtgccaagagcccaggcagacttagagggggaagtgctttgca

SEQ ID NO: 4084 - DNA, 74 bp, Homo sapiens
cagctctttttctccttgattgcacaagttccaattctgatggagctggttaatcattctttgagaaatagttg

SEQ ID NO: 4085 - DNA, 88 bp, Homo sapiens
tgagcatatgagtgttagtatactgaaggcatgttataccagtttctgtgcagcatgctaaaagttagaacttcttcactggtgctta

SEQ ID NO: 4086 - DNA, 78 bp, Homo sapiens
gtgggcactccagtgacagagcagaagttctggggactgtcactgatggcagagctcaggcctgggctgggtgcccgc

SEQ ID NO: 4087 - DNA, 78 bp, Homo sapiens
gcaaaacctcctcctggtgcagtgttccgaaatcacctgtggtgggtttcattagcatgggcacaggggagggaaggc

SEQ ID NO: 4088 - DNA, 79 bp, Homo sapiens
attattcatgctaatgccttgcatgtgtagagtttatactttacaaatgctaatcaggcccaaggactacatgaataat

SEQ ID NO: 4089 - DNA, 81 bp, Homo sapiens
gccagtagtggtggacttgtacgaatctacgtgtccaatgacgacaatgtggatatgagtcttttcctttcccattttggc

SEQ ID NO: 4090 - DNA, 80 bp, Homo sapiens
gtggctactctatgcttccaaaaacttacataatgttaaatcttagaacatttacaagttgtcagggaacatgtacccac

SEQ ID NO: 4091 - DNA, 86 bp, Homo sapiens
ggccgcgggccgcgggctacgcagggagcacggggccctcgccgcccccaggccgcgctccttagcgttccctgcggctcgtgccc

SEQ ID NO: 4092 - DNA, 76 bp, Homo sapiens
tcttaactgtttttattgctgtggaaatatttcagaatttggaatatttccacttgcaatagtgtcatctttaaga

SEQ ID NO: 4093 - DNA, 66 bp, Homo sapiens
ataaaatgagacggatgacttttgctaaagttcagctcaagtttaaattcatttgtttcagtttat

SEQ ID NO: 4094 - DNA, 67 bp, Homo sapiens
tcattaagatggatgaaataaccatattgactgtttagtgagctggttatttcagtaatcttaatga

SEQ ID NO: 4095 - DNA, 86 bp, Homo sapiens
agtgattagattctgcatttatttaggttattcgcctaaaaaacctggtttccatactgcaaataaatgacaggaacttttccact

SEQ ID NO: 4096 - DNA, 72 bp, Homo sapiens
gtgataaaataatagaaaggctttcagaataatgaacacacattctgtcctagttgtgctttattttatcac

SEQ ID NO: 4097 - DNA, 62 bp, Homo sapiens
gccctaatgcagccagtcggcccggggctggagctccggctggcttcgggtttcagtggggc

SEQ ID NO: 4098 - DNA, 61 bp, Homo sapiens
ctattttgggctcttgctgacctgggccaaagtcaggtccagtcaagagggcccaaagtgg

SEQ ID NO: 4099 - DNA, 89 bp, Homo sapiens
tttctgtaagttgaaacaggacctataaaggtctctacaccctgaagcaacgttttagaaagaaatcagttggtccttttctgcagaaa

SEQ ID NO: 4100 - DNA, 83 bp, Homo sapiens
atacattctcccagctataactctgctggcactaatggtatttatgtgccccagagctataaacctgttttaggtaaatgtat

SEQ ID NO: 4101 - DNA, 80 bp, Homo sapiens
gcatggatggcgcaaaggtttgtgtcctcaaagagccctaccaagtaggcctcacaagcctcctgcagcgccatcaccgc

SEQ ID NO: 4102 - DNA, 61 bp, Homo sapiens
tttgtgaatctagctcatagataaaaagaaaggtcagagttcacagagctagtttatcgca

SEQ ID NO: 4103 - DNA, 85 bp, Homo sapiens
ccgcaggcaggtatttactctattgccatgaagtccatcagagataaaggcctttatgttaattaaagtaccacattgcctttgg

SEQ ID NO: 4104 - DNA, 68 bp, Homo sapiens
ggagcggcgcccggcccggcccttcccccgccaggcggctgtggctgggccagggcggggcgcgcttt

SEQ ID NO: 4105 - DNA, 90 bp, Homo sapiens
attggaagtcctgagaccaaggttctgctttggcttctgctgtgagtcaccctgtggcctggagcaaacctgttaactcaattttccaat

SEQ ID NO: 4106 - DNA, 79 bp, Homo sapiens
ccaggtttctttttctttttaatggggcttgttgatgtgtcctgcggcgagtggccattggaagaatgtggagggctgg

SEQ ID NO: 4107 - DNA, 66 bp, Homo sapiens
atggaagtgctatgtgttatgcagagtgcatgcagttcattcatgcataaacaatatcattttcat

SEQ ID NO: 4108 - DNA, 73 bp, Homo sapiens
ctctggcgggatcttcttattccaattcattgtactggtttaagaccaacgctgtgggttaggtcctgctgag

SEQ ID NO: 4109 - DNA, 82 bp, Homo sapiens
gctcagaagtgatgaattgatcagatagacgaggccgggcttgtccccggccactgattatcgaggcgattctgatctgggc

SEQ ID NO: 4110 - DNA, 75 bp, Homo sapiens
tattttaagtacacgaaaagttgagtgggatctttagataaagactttcactcactttaatatactgtcaaagtg

SEQ ID NO: 4111 - DNA, 82 bp, Homo sapiens
tagttcaaccggctaaggaattaaattacttggcctaagagaactcaggtccaagttcttattaccatagctttgatttctg

SEQ ID NO: 4112 - DNA, 86 bp, Homo sapiens
acttccaagaagatgaaataatacataggtcatgaatacataagttttatttctatgaccaaaagtatttcactactccaagaagt

SEQ ID NO: 4113 - DNA, 87 bp, Homo sapiens
tagctggacttttcctgaggaaaaaagttgacctgaccagtgtatgaaattcaaacactgtataggaacaaggtaaaagcacaggta

SEQ ID NO: 4114 - DNA, 76 bp, Homo sapiens
ctggcctggctctgctccgcaccgtgaatttttcattaatgtgcacaggtgacgccacggggcagccgcaggccag

SEQ ID NO: 4115 - DNA, 64 bp, Homo sapiens
aagcccgcgccccgcccggcttggccggcgccgggggcagcgcagccggcggggcgcggtgctt

SEQ ID NO: 4116 - DNA, 85 bp, Homo sapiens
aagaaaaatggtaagagtatgtggtgggaggctgaagtcaataaattgaatatgtcttcccttttttatttattgctgtgttctt

SEQ ID NO: 4117 - DNA, 87 bp, Homo sapiens
aagcccacccctggggcccaccgtccccccacagccaccctcggccctggagtcggatggggaagggccgccccccagggtgggctt

SEQ ID NO: 4118 - DNA, 90 bp, Homo sapiens
tcaagttactagaaggcggggttgatccacatgctgaggaccattgtgaggctacagcaatgcaccgggcagcagccaagggtaacttga

SEQ ID NO: 4119 - DNA, 82 bp, Homo sapiens
aaatgtccaatgataactacaaatttaaatgagaaaaaagcaaaattctcataattttgtaacttgtccaaattttacattt

SEQ ID NO: 4120 - DNA, 75 bp, Homo sapiens
ccctcctggcctcgacccctaagggcttcgcccctcccaggggcctgtaactaagtcgggtcctgccaggcaggg

SEQ ID NO: 4121 - DNA, 89 bp, Homo sapiens
ttaatgtttactagaataaatgtaaatattttaaaacatacaacagttccaagaacatgtgatttccattttattttatgaaacattaa

SEQ ID NO: 4122 - DNA, 71 bp, Homo sapiens
gggaccggtttcaagttcttacccttctccttcgagcatattcgggaagggaagtttgaagagtgagtccc

SEQ ID NO: 4123 - DNA, 68 bp, Homo sapiens
tttttcatctgcactgccaagacagcgtggttgaatgggaagcaggtggtctctggcaaggtgagaga

SEQ ID NO: 4124 - DNA, 74 bp, Homo sapiens
aggacaagttttggcagaggttctatgtttgtaaaccatttaggactgcaggaagctctgtcaccccatgtctt

SEQ ID NO: 4125 - DNA, 68 bp, Homo sapiens
tcaggctaatacagaagtgtattaaaatggccggatgccaatttagttcatcttttgtgaaatcctga

SEQ ID NO: 4126 - DNA, 66 bp, Homo sapiens
gttttcgctctgacatttttactcttctcggaaggaggaggaggtggaggtggaagagatggaggc

SEQ ID NO: 4127 - DNA, 86 bp, Homo sapiens
ccggctgtggcgcgctctccgcctgctcctcacatccacacagctgctgggagaggaggaaggaaaggcgggcgcgccgcggatgg

SEQ ID NO: 4128 - DNA, 84 bp, Homo sapiens
cagccaatgtttctggaagacctccattcaggaaaggcaagcacatctgtgcctgaagtggctgggtcccagcagatttggctg

SEQ ID NO: 4129 - DNA, 81 bp, Homo sapiens
ctgtacatgcttaaaaaggcaaagagtaatgccgaccctaagggtttagatgcagattctctggtcattgagcatgtccag

SEQ ID NO: 4130 - DNA, 80 bp, Homo sapiens
gatgaggctgtattaatttaggagaaatgtgcactggcattctggcctgcactcttcttaattatcttacagtccccatt

SEQ ID NO: 4131 - DNA, 65 bp, Homo sapiens
gggtgaatggatttatttattcatgaataaattctttattcatgaaagaacttatttattcactc

SEQ ID NO: 4132 - DNA, 86 bp, Homo sapiens
actatgaaatcgacgtgtaatgagtcacttaccttaaagagctagaaatgcttttaagccaaagggaccattactgattaaatggt

SEQ ID NO: 4133 - DNA, 74 bp, Homo sapiens; identical to SEQ ID NO: 1296

SEQ ID NO: 4134 - DNA, 81 bp, Homo sapiens
gttcaattttggcttttgagtgactcatatgtggttagcattctgctgtggcattgggtggtctttagcattttattggac

SEQ ID NO: 4135 - DNA, 77 bp, Homo sapiens
tacagcgggagagaggctgttaactaggtgacctcgttgcacctgtgtgtttcacagcttccttgggagccgctgtg

SEQ ID NO: 4136 - DNA, 88 bp, Homo sapiens
tctttccacctggacatcttcttttacagcctcattacacttgccagtgattcatgggtgttaggcttgactgaggagggtggaagga

SEQ ID NO: 4137 - DNA, 60 bp, Homo sapiens
aacagcacaatgtggttttaactggttctagaaaattctgatagtgaaatattttctgtt

SEQ ID NO: 4138 - DNA, 75 bp, Homo sapiens
aagaccttctgggatttcgttacctaacgcctattagtgataataggtattacgtctataaatccctaggtgctt

SEQ ID NO: 4139 - DNA, 77 bp, Homo sapiens
tttatgaatatacccaatgggactggctttggaatttggggttaatatcaggccacagtctcatacacattcatgaa

SEQ ID NO: 4140 - DNA, 68 bp, Homo sapiens
atttcctagttattgttgtagtgagaaggcattttcaatttcttacataacactagcggatagggagt

SEQ ID NO: 4141 - DNA, 88 bp, Homo sapiens
ctctcctttgattcttctcctggaaagcagttttctactattttccgttagaatcatttccagggtaaatcacacttcagaggcagag

SEQ ID NO: 4142 - DNA, 62 bp, Homo sapiens
aggagcacagggaggggcgagggtgcccttatctccctggacctgccctggctggtgctgct

SEQ ID NO: 4143 - DNA, 90 bp, Homo sapiens
ccagcaaatgctgaaaacaaacatttgatgaccagggtttaattttcaaatccttaaggccagagtgtttgccttggtattgtgtgctgg

SEQ ID NO: 4144 - DNA, 74 bp, Homo sapiens
ggcccgtgcagctggcgccgggctcgctggcgctagtgctgtgccggctggaggcgcagaaggcggcgggggcc

SEQ ID NO: 4145 - DNA, 88 bp, Homo sapiens
ctgctagtagaattgttcctgaatcctatgatggaattaaacatataaatatgccatggtattctgcagagagcaacattacttccag

SEQ ID NO: 4146 - DNA, 73 bp, Homo sapiens
gcccaacctagggagcagggaacagagagctgccccgcggcaccatctgtttctgccagcatctatgttgggc

SEQ ID NO: 4147 - DNA, 84 bp, Homo sapiens
gccatctgttgttaattttgtagttgtattaaattccatcctttggctggattttaagcaccaaaagcaaacttagacagaagc

SEQ ID NO: 4148 - DNA, 73 bp, Homo sapiens
gtattggcagtttttccgttttcatttgtgtgtgaatttttaatataaatgtggagacgtaaagcattaatgc

SEQ ID NO: 4149 - DNA, 89 bp, Homo sapiens
gtttgattatgttggcttggcaggagaaagtgtttgaacacagtaatgttcaaatattcttatttgaaaaacaagccagcagaacaaac

SEQ ID NO: 4150 - DNA, 80 bp, Homo sapiens
gtaagtgtggctcaagattatgtttcagaaaatacagaaagataaatctgtatttctagcacactgccccccacgcttgc

SEQ ID NO: 4151 - DNA, 80 bp, Homo sapiens
gcatgaaaagctgggagttctttctggcaagggttggtgataatagcagcttagtcaggggtggctcccacagcctgtgc

SEQ ID NO: 4152 - DNA, 73 bp, Homo sapiens
aagcctttttgtagctgctggaaaattatatttgggctgcaattacctttcgcagcattgcacagaagggttt

SEQ ID NO: 4153 - DNA, 67 bp, Homo sapiens
ggagcttttaagacacagcaaatatatttctttaagagaagtttatttgcttgtttaagagagctgc

SEQ ID NO: 4154 - DNA, 74 bp, Homo sapiens
tccgtcagccaagtgacaggattccccatcagggcctttgactgtgtggggctcttcaactttatgctggcgga

SEQ ID NO: 4155 - DNA, 84 bp, Homo sapiens
ggtccattttaatcacaagccagctggtctgagggcacgggggtatgtgccaaggaagatggtatgtgggggtagaaatgggcc

SEQ ID NO: 4156 - DNA, 90 bp, Homo sapiens
atctttgcatcccccgctgcaccctgtgcctgcccactgggcactcggtggatggtgtgcgggcggatgggtgagtgagcggacaaaggt

SEQ ID NO: 4157 - DNA, 75 bp, Homo sapiens
gttttcacagttcaaaattttgactaagacactgtgtcagtgtgtttggtacatgctgtgtttgagcctggaagc

SEQ ID NO: 4158 - DNA, 87 bp, Homo sapiens
ctgagaattctcctcctcgtacttggtttctttgtggccagtctttaccagaagaaaagaacaggtgcagggggagtgtcccctcag

SEQ ID NO: 4159 - DNA, 66 bp, Homo sapiens
cacccaaccttctcttccctagagggtagttagagctacaccctatggggcagagaggaaagggtg

SEQ ID NO: 4160 - DNA, 72 bp, Homo sapiens
tacctcaaagacaggctggggctgcagccaagtcaggcaatgagctggctgggtgccagtctccctggggtg

SEQ ID NO: 4161 - DNA, 83 bp, Homo sapiens
agactgcatctcttgtttagaaagggcctttttcactttacagttgtgcttgttaatagtgtggtgtttctaaacaacagttt

SEQ ID NO: 4162 - DNA, 75 bp, Homo sapiens
ctgaatttcccatttggggttttattagcttttagtaaaaggcgacattgtgaagaaacccagattagaattcag

SEQ ID NO: 4163 - DNA, 71 bp, Homo sapiens
gacggcagctggctgcttcctctcctccggtggccttattataaaggcaggatgggggagccagcgccctc

SEQ ID NO: 4164 - DNA, 87 bp, Homo sapiens
tctgtcagcatttgtgaggacaaaccaccccactatccctgatcacttagccgtagacgacatactgtgtcctcagatctgctcaga

SEQ ID NO: 4165 - DNA, 71 bp, Homo sapiens
ctgaatgcttttgaaaagttgtagattacaaacatgaaatcacaattaatatcctctaaaagtaatttcag

SEQ ID NO: 4166 - DNA, 75 bp, Homo sapiens
tagaattgtggaagtgaaagctattatgttttcagtcctgacaagacgatagtgttgttacttccatcagttttg

SEQ ID NO: 4167 - DNA, 73 bp, Homo sapiens
cttcgggtcactgggcgagttctggtggtggggctagcagcctctggctcaggacggtcaacaggactggaag

SEQ ID NO: 4168 - DNA, 81 bp, Homo sapiens
tctccactgtgcagcccagtatcaaggtgcaggtcccgttctcctgggtcttgtttaaaactttaatttctggagtggaga

SEQ ID NO: 4169 - DNA, 79 bp, Homo sapiens
tctgctcaggctgctttaattaagcccgtttattttctttttgtttgaaaggtgctgagattagaagcgtctgcacaga

SEQ ID NO: 4170 - DNA, 85 bp, Homo sapiens
gacagaaactcattaacacagtgggtatcagtattgattatgacttttagactttactttttcccattatagtttaatttctgtc

SEQ ID NO: 4171 - DNA, 72 bp, Homo sapiens
gcttcctcccttgctgtctggggagctccaccttccgggtggcacttaactgactggccaatgggaggaagc

SEQ ID NO: 4172 - DNA, 84 bp, Homo sapiens
gagttaggtttaaactctgtcatgtggctaagcaattgttcttctatttttgttcacctttagcagtgacttttttcctagctt

SEQ ID NO: 4173 - DNA, 85 bp, Homo sapiens
atgttttaactaccttgacagactaaacttacatgggcatttgaacatggaggaaaagaagtaagagtgtttggggttaaaacat

SEQ ID NO: 4174 - DNA, 88 bp, Homo sapiens
ctgccattatgcttttcatggagccaagcacactgttgttgattaataaataatgggttgtttatcttggaattgttttcattggcag

SEQ ID NO: 4175 - DNA, 64 bp, Homo sapiens
aggacctccattttgtgggctaattgcttgattaccagcctgaaacaaaatggaggtgagacct

SEQ ID NO: 4176 - DNA, 80 bp, Homo sapiens
gtagccctagtatatatttatagaacggttctgtgcaaatctatttcaggattacacagaaattttattgcctgggctat

SEQ ID NO: 4177 - DNA, 67 bp, Homo sapiens
gtcagggcattagcagtgctttagcctggtatcagcagaaaccagggaaagctcctaagctcctgat

SEQ ID NO: 4178 - DNA, 77 bp, Homo sapiens
tcccgctgtcatccctccagcgagacaaaaggcaatttaccgaaatgttataatcacctggaggctggcacgcgggg

SEQ ID NO: 4179 - DNA, 85 bp, Homo sapiens
tcagcctcatgacttatgcttgcttcaaactgaatttgagtctaagctcaaagggcatgcatttttgtttatgaataagggctga

SEQ ID NO: 4180 - DNA, 71 bp, Homo sapiens
gcattgtgaatccaataatagacctttaaaaaagaacaattcttctaaggatttatatatatttatagtgt

SEQ ID NO: 4181 - DNA, 86 bp, Homo sapiens
gttcctaacgagctgggtggggcaggcagacaatggagccctcccagcctgcctggctgccccctgcctggagctccccgaggaac

SEQ ID NO: 4182 - DNA, 69 bp, Homo sapiens
tgatcacatatgttatgctaattatataattagacttaattataacaattgtgccaatacatagtatca

SEQ ID NO: 4183 - DNA, 75 bp, Homo sapiens
tcagaaaagagactgattgaggaaaactgccatgttccattgcatggcagtttaagcgagacagtttccccctga

SEQ ID NO: 4184 - DNA, 86 bp, Homo sapiens
gggccatttctgtgtgcttcagccatttttcacactgaaaatcatattatgttagcagcgaaagaggcagtgtgcagaatatgtcc

SEQ ID NO: 4185 - DNA, 86 bp, Homo sapiens
tcctttcaagtttttatagcaagaattatttttaatgtggactatgggtgcatattaatattttgaggtaggaatattaaaaagga

SEQ ID NO: 4186 - DNA, 68 bp, Homo sapiens
agattttgtcaccatggcaactggtcattggaccaatgaaataatcagttgtcatggtaacatgatct

SEQ ID NO: 4187 - DNA, 73 bp, Homo sapiens
gttccctggatgctgtcggccttgtggggtcctcgcagcccatacagtgtcaggctgtacagagtcccggaac

SEQ ID NO: 4188 - DNA, 90 bp, Homo sapiens
tgagcggctgcctcattcagtccatgtctcggcctgactacaatgatgaagcgatggaaggcagagtggattgaaagggagcgaggctca

SEQ ID NO: 4189 - DNA, 61 bp, Homo sapiens
ggaaaaacgaaagtaatgattcttgcccacagggatgtgatcccactatttctgttgtgca

SEQ ID NO: 4190 - DNA, 82 bp, Homo sapiens
tgtcagaaatagatggaagatgacaatttatattttgttgttaccactagtgtaattctttcatatttctatctcaatgaca

SEQ ID NO: 4191 - DNA, 79 bp, Homo sapiens
atgtggttgtgggaaacacttttgtagatgtcctttttgaattggaaatcaataaacaattttctttccccaatcatgt

SEQ ID NO: 4192 - DNA, 60 bp, Homo sapiens
agcagcgcactcaggtgggatgcgtctgcctcctcctggtccctcctctttcctgctgat

SEQ ID NO: 4193 - DNA, 62 bp, Homo sapiens
acatttatctctttaatttggaaagaaagcaacattttctttccaacttagacagtatatgt

SEQ ID NO: 4194 - DNA, 70 bp, Homo sapiens
gagtgtcattaaggttttagaaatgaatgctcctaaggaaaggaggatcactaggactacaatgatgctc

SEQ ID NO: 4195 - DNA, 82 bp, Homo sapiens
ttcttttatatgcaattttagcctctgatttttcagcaatgagctttgaagtcaagaattcagctgctcctgcatcgaagaa

SEQ ID NO: 4196 - DNA, 78 bp, Homo sapiens
gggggtcaagaatgcttggcagctccaggtggccaaggagagacagctgagcagccaaggatcctggacagggccccc

SEQ ID NO: 4197 - DNA, 86 bp, Homo sapiens
ctatttgccttcctacctctcagcccatcttatttgccagtctattgcctgcatttttgggctcaaggtcagccaaggattaatag

SEQ ID NO: 4198 - DNA, 90 bp, Homo sapiens
cccctgggctctcgacctgcgccccagcccccagtacctcgtccggagcactgtgagggagctgcagcaggactcaaggcagcccagggg

SEQ ID NO: 4199 - DNA, 81 bp, Homo sapiens
tttttaggattctgcatagatttcttttaaactggcattcttgcctaatgatgttatctaggcaccattggagactgaaaa

SEQ ID NO: 4200 - DNA, 74 bp, Homo sapiens
gcctgttgtttcactgtcatctgtctctcaggtatgtccgcatgctgggggcactttacatgaggctgacaggc

SEQ ID NO: 4201 - DNA, 88 bp, Homo sapiens
gaagatgtgggtctccaagaaggaatatgaggaagacggtgcctgatctatccacaggaaaaccttctaatgttgggatatcatcttc

SEQ ID NO: 4202 - DNA, 83 bp, Homo sapiens
gcccctggggttcctaccagtgggagccgggggcatgtcctgcagccccaagaggcataggtggtggggacatggctgggggt

SEQ ID NO: 4203 - DNA, 83 bp, Homo sapiens
gtctccaaggccttgagtcaaataccctttatgaatactttatagaaagtagatttcactcagaagtaacatgctttggagat

SEQ ID NO: 4204 - DNA, 88 bp, Homo sapiens
tggtgtcctagacagatttcactatactgccctactctgagcagttcaaagcacagaggtaagggtaggtaggtgaactgggatgcta

SEQ ID NO: 4205 - DNA, 90 bp, Homo sapiens
cttccttgacttgtggttatttcccaaaattcttcctttaagaaattcaaaaccctcacctaaaaggaaagaagttacccaagtaggaag

SEQ ID NO: 4206 - DNA, 74 bp, Homo sapiens
tgaggaacagaacattttgttactgaatctgaaaggccatttcttaataagaataaaaagttccctgttcttca

SEQ ID NO: 4207 - DNA, 72 bp, Homo sapiens
ggaggcagctacccctccatgggccaccgggccaacctggcctgcagccccctgggtggtggggagccctcc

SEQ ID NO: 4208 - DNA, 79 bp, Homo sapiens
gagctctgctttacaccagccgagtttaaggtgtcagtgggacattgaagtggaactgggaggtgcggggagtgagctc

SEQ ID NO: 4209 - DNA, 80 bp, Homo sapiens
agtagaaaatacaggcggtagaagataactgaaaagactaatgcaacattagattcaaatctatatctcctgtagctact

SEQ ID NO: 4210 - DNA, 79 bp, Homo sapiens
atgagttaggagttaactagtagagcatacttacattagcgcaaataagctatcaggtctcctggtcatcttggctcat

SEQ ID NO: 4211 - DNA, 78 bp, Homo sapiens
cctgagcctgtaattacttcaggagtagggaatgaaaagggcatatctcctctgctttcagggaatgacagactcggg

SEQ ID NO: 4212 - DNA, 74 bp, Homo sapiens
tgaattaaggctgaccagagtgtttctttggaggaaagagtccacaaatggaaaactttgagtaccttaattta

SEQ ID NO: 4213 - DNA, 62 bp, Homo sapiens
acttggtaatttgatttagacaggggaattttctgctgataaatctaggtagattaccaagt

SEQ ID NO: 4214 - DNA, 68 bp, Homo sapiens
tgtgtcttttctatacatccacaaggatacttacctagtgccttctgggttctaaaggagaggatata

SEQ ID NO: 4215 - DNA, 83 bp, Homo sapiens
gagatattgccaacaatggaaaaaataaatatgagcctgagtcagaataatctgaaaccagaaatgtgtgttggtaataactc

SEQ ID NO: 4216 - DNA, 80 bp, Homo sapiens
gcaaaataactgtcattatggactcagtcatatttctctttaaaatactattgaaaagtccatgaaaatgattaaagtgc

SEQ ID NO: 4217 - DNA, 71 bp, Homo sapiens
gctgtgagcagaggctggttataaatttgaactccctcagcccatttgcaactctgcctctgttctcttgc

SEQ ID NO: 4218 - DNA, 75 bp, Homo sapiens
catcccctggggccagagtgttgggtggggccagcctggcacccccacacccacacctgggacttcccctggatg

SEQ ID NO: 4219 - DNA, 77 bp, Homo sapiens
ctccttgtcgtgtcagtgcagaggtcatctaaagaggaggcctaattaatcaatctgtcagaggcaatgaggaggag

SEQ ID NO: 4220 - DNA, 84 bp, Homo sapiens
ctgccaaagactttttagcaattcccattcatttttggtgatattgtatttgaacaaaaatgattgctccccaaggcttggcag

SEQ ID NO: 4221 - DNA, 73 bp, Homo sapiens
ggtgtcatagttagtctctcatctgctggtggatctgatttgcccagctgacaagtgagaagactgtgacacc

SEQ ID NO: 4222 - DNA, 74 bp, Homo sapiens
acagatgaagaagttgattaaatgatcagggaagcagatcctgatggtgatggtcaagtaaactatgagtttgt

SEQ ID NO: 4223 - DNA, 81 bp, Homo sapiens
cctgacagggatgaaaggaaacaaggctgtgggtgacatgcatctattgtgtgtccacaaacttgcctggaatctatcagg

SEQ ID NO: 4224 - DNA, 85 bp, Homo sapiens
gccagtgccagcaaggactctttgtttaaggcagacggttggaaaataccataagggcaagatataaagagcttgctgggaggac

SEQ ID NO: 4225 - DNA, 83 bp, Homo sapiens
gaggagtataagtaaacacagccttctcccataagtacacagtattgaatgaaggagaaaagggctttatactctattccctc

SEQ ID NO: 4226 - DNA, 67 bp, Homo sapiens
gcactcgctgctcagctggctggcgtcgaagccggggctcacgtcgatggccagcgagcgcaggtgc

SEQ ID NO: 4227 - DNA, 90 bp, Homo sapiens
ggcggcgcgcgtgtggccgactctgtatgtgtgcgcctgtcagtcaacgctgacaggccgcagcccattggtcaggccccgccggccgtc

SEQ ID NO: 4228 - DNA, 87 bp, Homo sapiens
ctctgatggctacctgcagaagacagactaatccagtgttatttaacgtagccacgggtggcttcttctgtcagcaggcctttagag

SEQ ID NO: 4229 - DNA, 73 bp, Homo sapiens
gctgttttgtcatttcgggcatggagtcctggttctattgcagggccttgtctccatggaaatgaaaaatagt

SEQ ID NO: 4230 - DNA, 84 bp, Homo sapiens
ccttggacctaggccttggacttgtgtttggtagaagaggtgctcttatttgctgggtcagaagccaggagcccaggtgcccgg

SEQ ID NO: 4231 - DNA, 68 bp, Homo sapiens
tttgtgaagagggacataagataaaatgatgttatacatcaatatgtatatatgtatttctatataga

SEQ ID NO: 4232 - DNA, 88 bp, Homo sapiens
gtgtagctctgcgaggtggcagagtgcgacagcaaaggactctgtgttgttctgctgcacgcccgcattcaccgcctccaggctgttc

SEQ ID NO: 4233 - DNA, 62 bp, Homo sapiens
aggaggccaggaatgttcgctctctaagcactgcattctttctcagtattttgtttgctctt

SEQ ID NO: 4234 - DNA, 82 bp, Homo sapiens
atttttgaagcacttaaagtcatagaaattcaaatgctgatattttcttcttatactctggattttcaagtgctttagagat

SEQ ID NO: 4235 - DNA, 83 bp, Homo sapiens
ttgtaaagcagttagttgctgcacatggataacaacaaaaatttgattattctcgtgttagtattgttaacttctttttgcga

SEQ ID NO: 4236 - DNA, 80 bp, Homo sapiens
acccatctgtacctttcttctccagcgcgttcgtggttaatgtccccccatgcgcgcgagaagggagataattgctgggt

SEQ ID NO: 4237 - DNA, 74 bp, Homo sapiens
gaaaatccataagctagggtgacttttgagttaaattaaattttatggctcaaaaaatgctttgcttggttttc

SEQ ID NO: 4238 - DNA, 87 bp, Homo sapiens
ctcatagtagaaactgtggctacatctgggatatcattagcaagctaaatgctgactatcaaatcttggattgtggccttctatgag

SEQ ID NO: 4239 - DNA, 88 bp, Homo sapiens
ctgtgtggagccgattacacagcagaacgcaatttttagcctgaccttaaaagcattaccttctgctgcgtgattagaaaacatacag

SEQ ID NO: 4240 - DNA, 85 bp, Homo sapiens
gaagcaatttaagcattttggcttcctggggtgagttggcaggcacacttctcatctcagggatgccttcgggtgaaggtgtttt

SEQ ID NO: 4241 - DNA, 84 bp, Homo sapiens
acttaatttcctcaggaataacaaaatgggagctacaatacatctttgtttagctgctatggttttcattaaatttaattaagt

SEQ ID NO: 4242 - DNA, 65 bp, Homo sapiens
tccacaggagggagctgacgttggcttgaaaggagtaaagtcaacatctgctgctttcctgtgga

SEQ ID NO: 4243 - DNA, 87 bp, Homo sapiens
ccaggcagtacaagtaggtgggccagaacctccagttgttcctcagagcactggagatgcagggtgccgaggaagagagctgcttgg

SEQ ID NO: 4244 - DNA, 74 bp, Homo sapiens
ggcttgcattagaaaatacagaggtatactaaaattaacaataattatgtgattctgtaacttactgccaagcc

SEQ ID NO: 4245 - DNA, 74 bp, Homo sapiens
gctgggaagtcctctgcctagtctaagatcttccctgtgatcttcaggtattgctcggcccagttcttctcagt

SEQ ID NO: 4246 - DNA, 89 bp, Homo sapiens
agtgattaactgcaagaaatggactgagtagactgtcatcaatctctttcctttattttcaagagctcatttcttgaaacttaatcatt

SEQ ID NO: 4247 - DNA, 82 bp, Homo sapiens
tctccttcagctgactcccaggccaatcagcatttcctctctgctaatgtcagatgttccctgggaagtcctgctgaaaaga

SEQ ID NO: 4248 - DNA, 82 bp, Homo sapiens
ggcgggggctgggatcgggagtctcgcggaaggagcctgttggctttgtttggaaccggggttaaagtcaccagccgctgct

SEQ ID NO: 4249 - DNA, 75 bp, Homo sapiens
gtcaggccggctagaagaattcaaagcgttcagggaacccacaaaagatttcttgcagccttttagctgcctggc

SEQ ID NO: 4250 - DNA, 76 bp, Homo sapiens
gcaggttttagaaatatatttatggtagcgataagggtttccttggctgacatcactaaatgttcataagacctgt

SEQ ID NO: 4251 - DNA, 66 bp, Homo sapiens
gcggtggggtgggggtggggaagagggcgagagctaagatcctctttctctctcccccgcccctgc

SEQ ID NO: 4252 - DNA, 83 bp, Homo sapiens
cagtgcttgtagctgtggcagggtccccaggcagcaggataactgctgcttgatcattatccctgctaaaactgaagctactg

SEQ ID NO: 4253 - DNA, 81 bp, Homo sapiens
aatgtatgtgagaaaagagtatttttgaaacttttcaaaaataaaagaaagatcaagaagtgcttttaactaatatgtatt

SEQ ID NO: 4254 - DNA, 62 bp, Homo sapiens
cggagccccaggagtttggtggcggaggaggcgctgccgtcgccacgctcccccgcgctcct

SEQ ID NO: 4255 - DNA, 84 bp, Homo sapiens
tactgtaaggtcttttgagaggtggaggggagcaatggcccacagagccgcccccacctctaaccccaagagcccccaacggta

SEQ ID NO: 4256 - DNA, 82 bp, Homo sapiens
gtcgcccatcattgccaaatgtgtcctccagaaagcgcagcccaagtgtcatctggtccacgatggcaccgtagtgggtggc

SEQ ID NO: 4257 - DNA, 64 bp, Homo sapiens
ccatttttgttccttccttgctcaagctaatggggcttgataagaaagaagaaaacaacaatgg

SEQ ID NO: 4258 - DNA, 76 bp, Homo sapiens
taagaagtttaatgtttccaatgttacttctaaaaactttcttgtgaggtacacttagagacaatgttatttctta

SEQ ID NO: 4259 - DNA, 70 bp, Homo sapiens
gtagggacagctctccgagccgggatggtggccggtgcactccaccgcgggcatggagccgctgtcccac

SEQ ID NO: 4260 - DNA, 83 bp, Homo sapiens
gtatattttatgtgataagtggaaagtgtcaaaatgagccacacataaagtggtgacaaaataattcacttcaatgaaattac

SEQ ID NO: 4261 - DNA, 76 bp, Homo sapiens
aatacaacagagatgaatggataagattgctacattgtaatgtagtttgttttataattattcaccacgttgtgtt

SEQ ID NO: 4262 - DNA, 75 bp, Homo sapiens
tcaggatgtggtggaaccaaattgcagttttctaattgagaatgtaatcttggtctttaaagaacagagttctgg

SEQ ID NO: 4263 - DNA, 74 bp, Homo sapiens
gagaacaatcgagatggatcaagttacactgaggtaacaggctgacctgtccagtgctgaatcgatctgttctc

SEQ ID NO: 4264 - DNA, 85 bp, Homo sapiens
tcatctctctctgatttactgtagaagatccatttctaaaaagttaaaatggttgtctcttttatgtatccatttgaggaggtga

SEQ ID NO: 4265 - DNA, 75 bp, Homo sapiens
ccagatctgtaggcactgtcagctattcctatggatgggaatactagcattgctgatagtagtaaataacaatgg

SEQ ID NO: 4266 - DNA, 86 bp, Homo sapiens
tctccactggccgatgctttccaatgcgacctgtcatcctgaaaggatggcctgttttgtttgcagagcgaatggttagtgggaga

SEQ ID NO: 4267 - DNA, 80 bp, Homo sapiens
tggcatctgttcttgaatcaggagcgtgtgtgaaagtggacagcctgtcaccctcacttctgggcacattagcagtgcca

SEQ ID NO: 4268 - DNA, 74 bp, Homo sapiens
tatttagtgaattttgcatataaattaagcttagcaaatgatctctttaatgcatacataatattcactaaatg

SEQ ID NO: 4269 - DNA, 74 bp, Homo sapiens; identical to SEQ ID NO: 1296

SEQ ID NO: 4270 - DNA, 89 bp, Homo sapiens
tgtttcatttccatttattgcaaatatgtggttttcaaaatgaaataaaattcagcccaggagcagccagagagcaatgaaaagaaaca

SEQ ID NO: 4271 - DNA, 75 bp, Homo sapiens
caacaaaaattaaaaaggaaaatcatgaaaagagccaacctcctcttttttgttttctcccttaatatattgttg

SEQ ID NO: 4272 - DNA, 86 bp, Homo sapiens
tcctagggctctcagttcatcaaatacactgccctatattcacacatatgaatagcctagggctggtatgactaagagtcctgtga

SEQ ID NO: 4273 - DNA, 70 bp, Homo sapiens
gaggtagaaggatgtttaggcagccaaggactgtaaagctacaagtatttcctaggcaggtgtctgcctg

SEQ ID NO: 4274 - DNA, 81 bp, Homo sapiens
gttctgagcactagagagaaatgatttggttacaagagctcctgctctcacaggattattgcagaatttatgtgccaggat

SEQ ID NO: 4275 - DNA, 86 bp, Homo sapiens
tccatgtttactaaaaggcctagagaacatatatcgggtgcctctcttctttccctttgtgttcgtccttttggcgaattactgga

SEQ ID NO: 4276 - DNA, 77 bp, Homo sapiens
tgttttcatctctgcacaactcgacagttctagtcttaataggagctgttcttttatttcagtgtgagaggaaaaca

SEQ ID NO: 4277 - DNA, 67 bp, Homo sapiens
gcaggctgcaggtgttctcagcattgtggtcatctaaaccagatgctgggggagttgaagcacctgc

SEQ ID NO: 4278 - DNA, 88 bp, Homo sapiens
gggatttgtggagggaggaaggatataaaagggcaaaaacaggagaccccggtgcctggattcagagccttcacattccggagatccc

SEQ ID NO: 4279 - DNA, 77 bp, Homo sapiens
ggttaaacagtgtatgtcattggcttgggtttctttcttcagggtgctgcccaagtgcatcagaaccctgtttaact

SEQ ID NO: 4280 - DNA, 81 bp, Homo sapiens
tgagatttgagttcagtacagcaattttgatttcttttcaggttggttaaaataagattttacatgaattcctaaatctca

SEQ ID NO: 4281 - DNA, 65 bp, Homo sapiens
taatttgattgtgtctgagacgataattgagttaaaacgcttattgtaacagacacatcagattg

SEQ ID NO: 4282 - DNA, 77 bp, Homo sapiens
agtgttttctctattcaacttgtttattccttatgaagcttctctcttcaagataagcaaagtatttagaatccact

SEQ ID NO: 4283 - DNA, 84 bp, Homo sapiens
ttcagaaccacttaagggctggcaaggaagagccacttatgaagtaatggcattggccttttgtgcaaagcctgtagttttgga

SEQ ID NO: 4284 - DNA, 60 bp, Homo sapiens
agttccacaaaaatattgacttcctatctccctgagggtttctggtattagtttgctcta

SEQ ID NO: 4285 - DNA, 78 bp, Homo sapiens
gactgtaacaatggaggagaagtagaatggacgcactatgctccatatataaatccatatagtaattaaaatatagtc

SEQ ID NO: 4286 - DNA, 61 bp, Homo sapiens
atgtctacaaacaggtttgttttacataaatggcttttctacaaatttgaaatgtgaatat

SEQ ID NO: 4287 - DNA, 78 bp, Homo sapiens
gggtgaaggcgcaggcgatcagcagcatggacaagaggttgccgcctgccacctcctccatcgcctggcccagcacct

SEQ ID NO: 4288 - DNA, 76 bp, Homo sapiens
ccatgtttaaaaagaaatggttcctacagtgttaactatggagtctgtagcgtgactctgtaatggaatatcatgg

SEQ ID NO: 4289 - DNA, 78 bp, Homo sapiens
ggtcaggggaggggtgagtacagggtcctcttgggcatggttgagagtgcacacctggaagtcctttcccaagtggcc

SEQ ID NO: 4290 - DNA, 67 bp, Homo sapiens
ggaggtgagggacaggactccgggggtcagcggtgggtgcggggcgtggggcctgtccatctcctcc

SEQ ID NO: 4291 - DNA, 75 bp, Homo sapiens
tggagccgcgggacggtagcccggaggcccggagcagcgactgcgagtcggcttccgcctcgtccagcggctccg

SEQ ID NO: 4292 - DNA, 84 bp, Homo sapiens
gacagatgggcagggacagatggcggagaagggatgggaggtgaagtcttcaccgttcctacagcattgctcctgtagaatgtc

SEQ ID NO: 4293 - DNA, 76 bp, Homo sapiens
gggtggagagagggggtagaaaggaagagggacatatgggagcctcttcccccatgcccgaaagcttctcccattt

SEQ ID NO: 4294 - DNA, 81 bp, Homo sapiens
tttccaggtggcatccattaggacaaacattatgaaaaggccactgaccaaaatgttgatttcctagctgacacctggaag

SEQ ID NO: 4295 - DNA, 62 bp, Homo sapiens
aggaagatgggaaggaaagaatgaggtttaatcacagacaatcagttcttttatgttttcct

SEQ ID NO: 4296 - DNA, 67 bp, Homo sapiens
gcggggggagggtggcggaggccgggtgtctcggaggtgacggccggtcctcgctctctccccctgc

SEQ ID NO: 4297 - DNA, 80 bp, Homo sapiens
gaaacaaaaaactaaaggaactttctcaagcacgttgtcttttctagataaaagctaaagaccttttagacccaggtttt

SEQ ID NO: 4298 - DNA, 73 bp, Homo sapiens
aggagctgcctgacggaagttgatgtcagctatctatgcattagggttgcattaccgccttcgtcggcctcct

SEQ ID NO: 4299 - DNA, 90 bp, Homo sapiens
gaatgtctgccgtttccacaatttgcataccattataataatgcctgattatgagctaaacatgctgatagtgggatgggttgaacattt

SEQ ID NO: 4300 - DNA, 77 bp, Homo sapiens
ggggactgtccccacctcacaggcggctagcagcagcagtttgagcctgtcaagtgggtgaggtggggtttttccct

SEQ ID NO: 4301 - DNA, 71 bp, Homo sapiens
tctatttttataagagcagcagagttgtcttctcaaaacggctgccaagctctgcttcttgggaagatgga

SEQ ID NO: 4302 - DNA, 77 bp, Homo sapiens
aaacatgataccagaattaatttgccacatgttgtctgttttaacagtggacccatgtaatacttttatccatgttt

SEQ ID NO: 4303 - DNA, 89 bp, Homo sapiens
acactcgcgcgcacacgctcactccgtgtccgcgaccgtcgtcgccggcggaaagcgagccacgggagggagtgtgtgcgcgcgtgtgt

SEQ ID NO: 4304 - DNA, 74 bp, Homo sapiens
ccctctgagggctgtttatgtttgcacactcggcttgtcctgtggacttgtctaactaagctcccctttgaggg

SEQ ID NO: 4305 - DNA, 67 bp, Homo sapiens
gttgtacagcagtataatttttcacttatttattccatcagtagatatggtttgtacaatgtacaat

SEQ ID NO: 4306 - DNA, 72 bp, Homo sapiens
aggcttcatcaggcatgcagagtctctagtagtttcctttaggggaaaagaaaaagattcgtcttgaagtct

SEQ ID NO: 4307 - DNA, 61 bp, Homo sapiens
agcagcccctaatgagaggctctgctccctttcccacctcgccaatgttgttgttgctgcc

SEQ ID NO: 4308 - DNA, 60 bp, Homo sapiens
agaagaaagtgaagctggggactgaggtgggtcccatctccccagcttgctacttctgct

SEQ ID NO: 4309 - DNA, 73 bp, Homo sapiens
ggagagtgtgtacatgagaaagaaaagggatgtgtgttaaattctgcatatccctctggatcggcacctctct

SEQ ID NO: 4310 - DNA, 87 bp, Homo sapiens
ctgcagctccacatttgaaggccttgtctaagtggcatctcaatgagatggtaatagatacttgaatcagatggagaggagctgtag

SEQ ID NO: 4311 - DNA, 77 bp, Homo sapiens
gccccgtggatggcagtggccacctccttggagcacttaacacccagaccgatgtggccattgtagtccacgatggc

SEQ ID NO: 4312 - DNA, 84 bp, Homo sapiens
gcagggttgggggagttggggtgggcctgagcctctttcctgctagagctcttggtcctccctgcctccaccacccatccctgc

SEQ ID NO: 4313 - DNA, 81 bp, Homo sapiens
tagctattccagatgaatttaccgaacaagaaaagcagtctggagattggtggaagcgtttggtgtcagcaggaatagcta

SEQ ID NO: 4314 - DNA, 83 bp, Homo sapiens
ttctccattaatgcagttatttgttgagttgagattgaaggagctcagtagtgggctttttaattacctgttttagtgtagaa

SEQ ID NO: 4315 - DNA, 69 bp, Homo sapiens
agagaaccttgtcattttcttttttgggggagaaaactatatttaccttaggaagggagggagttctct

SEQ ID NO: 4316 - DNA, 65 bp, Homo sapiens
ttcaggaggaggggcgggtgcagactaattaataaattaatacagcgacgctttttcttgctgga

SEQ ID NO: 4317 - DNA, 80 bp, Homo sapiens
tcagggctgctagccagggacacctaattggtgggacagagccccctcctctcaccaccctcaaagctggaatgttctga

SEQ ID NO: 4318 - DNA, 87 bp, Homo sapiens
taaccaggatttattgatgaatatgatatttgggggtataaaaactttatatatgtttttctttactcaattagtgaatcttgtcta

SEQ ID NO: 4319 - DNA, 74 bp, Homo sapiens
gctctgcaattttcattaagattaatcaagaacaacttttgcagatcattaataaacattgcatatgacagagc

SEQ ID NO: 4320 - DNA, 84 bp, Homo sapiens
tgagtcttccagtgatgtatacttaaaatcatgtaagttataaataaactttcatggtaggtgtaactaacttcatctgactca

SEQ ID NO: 4321 - DNA, 69 bp, Homo sapiens
agagaaattatgagattgctgacttcaaaggtttcctcatggaaaaatgcctgtaattttattttctct

SEQ ID NO: 4322 - DNA, 79 bp, Homo sapiens
tccatagttgtgtactgctccctgccacatgaacaaaaagtttgggggaataaggcgagcagtttacattttctgtgga

SEQ ID NO: 4323 - DNA, 89 bp, Homo sapiens
gggtggagaggaggaaggcatccactgctcctcgctcaaaaaccggagtgtcgggatcagccaggtggtggggctctctctctccatcc

SEQ ID NO: 4324 - DNA, 75 bp, Homo sapiens
ccctgttttaagagttttaggagatccctgagcacattgtttctgactcttaaccccaactccaaaatgataggg

SEQ ID NO: 4325 - DNA, 70 bp, Homo sapiens
atgtgttgtgtttgggttgatgcaatgttattttaatgagtttattggttcgatgcacaaaacaccacat

SEQ ID NO: 4326 - DNA, 85 bp, Homo sapiens
gaggttcaggtctccccccagctgtctcacccccactttgtccccactctagagcagggaggcagtgggggaggagttgtgtctc

SEQ ID NO: 4327 - DNA, 80 bp, Homo sapiens
cctgttacatttaaaacaaatggagagggagcaggtcccccgatcttcgtagttcctctccaccagacaatggtaacagg

SEQ ID NO: 4328 - DNA, 79 bp, Homo sapiens
tgtagttgtgaccagctgacagggcatccttgggtgttcagtcacccattgccaaatttccttgttggtcacagtcaca

SEQ ID NO: 4329 - DNA, 65 bp, Homo sapiens
cggggctcgggaccggctgccatcttagtctagggactgaggagtcgccgccgccccgagtcccg

SEQ ID NO: 4330 - DNA, 61 bp, Homo sapiens
aacagaaaggcaagggcagcaaacctttaatgcctacctccactatccttcgtcttctggc

SEQ ID NO: 4331 - DNA, 76 bp, Homo sapiens
gtgggaagatgctggcaaggtgctggagggccctggaggcaaagggcctgcctcgaccttgccccccataacccac

SEQ ID NO: 4332 - DNA, 68 bp, Homo sapiens
cattaattatatatgtcattattgtacttaactccttggttaggaagaaaaagacatatataatgatg

SEQ ID NO: 4333 - DNA, 74 bp, Homo sapiens
ctttctaccattcttctaagatggtggaagagtctcctcaagaggctacaccaaaaaggaaaaatgagagaggg

SEQ ID NO: 4334 - DNA, 81 bp, Homo sapiens
gatcattagctgcaggaagtcttcaatctgctgccagacatcagcctgcagcagtctgtcaaggccttgtacctgaagatc

SEQ ID NO: 4335 - DNA, 75 bp, Homo sapiens
agaggcattcagtaatcactgaatcactgaagatttcagtctaatctcatgaacaaagattttctgactgccttt

SEQ ID NO: 4336 - DNA, 80 bp, Homo sapiens
tctggctgcagggtggctcagtggaatccattttgttaacaccaacaattagttgtttcacatccagtgtgtaagccaga

SEQ ID NO: 4337 - DNA, 90 bp, Homo sapiens
gacaggagtacaatatttgtaagcttttatttgtatatttatatttataccaaatatctatgagcaattgtgagtaaaataccttctgtc

SEQ ID NO: 4338 - DNA, 73 bp, Homo sapiens
cagccaggcctggcccccgggaggccccactggtactgggacagtgggcccttgagaggggccatgggggctg

SEQ ID NO: 4339 - DNA, 67 bp, Homo sapiens
aagaaatgcttaagtgtttaattggcaactaatgagggtgccaattagggatcattatacatttctt

SEQ ID NO: 4340 - DNA, 90 bp, Homo sapiens
acccaaaggtgggggctgggctgagactgccggtgcggcaggggaagatggcaccaagaatgacagtgcttggctcagctgccagagggt

SEQ ID NO: 4341 - DNA, 73 bp, Homo sapiens
aatgtgcctccttttcatctggtggcaggctccacatgtaccatatgaaaaaggagttaataaaatgcacatt

SEQ ID NO: 4342 - DNA, 74 bp, Homo sapiens
cctctgcgtggtgggactcttctttggcagtgccatcatcatgtacatggcccccaagtcccgccatcctgagg

SEQ ID NO: 4343 - DNA, 89 bp, Homo sapiens
tctggtgggccctggaaaccatcagtgtatttggttactgtgtttacacagccggcaggacacacactgttcactcagggctccccaga

SEQ ID NO: 4344 - DNA, 75 bp, Homo sapiens
attctctgaagctgatggtgtgatgatgtgcatcccttccttgatgccaagatcacctcaggccagcttatgaat

SEQ ID NO: 4345 - DNA, 87 bp, Homo sapiens
gagcacagaggtatatttaagcaaagaaaggcattccacggctctcccgggacttccttccttcagctgaattataccaacatgttc

SEQ ID NO: 4346 - DNA, 73 bp, Homo sapiens
taaacatgatgtttatttcgggttactatttggtattctaagtattctggtaagtaagcacctctgatgttta

SEQ ID NO: 4347 - DNA, 79 bp, Homo sapiens
gatctagactgtctccactgcttatctagaaatgaatttgttgtttcatttttattaaagtttgaaaagtccttagatt

SEQ ID NO: 4348 - DNA, 71 bp, Homo sapiens
ctgtccaagaggaggccacagcgctggcctttccccacggaggccactgctgtcccgtcctctgtatacag

SEQ ID NO: 4349 - DNA, 82 bp, Homo sapiens
attgtggcagccttgactgcacagagctcacctgtgattcatgtgaatgtcacttgagctcccaggagtttgcagccataat

SEQ ID NO: 4350 - DNA, 79 bp, Homo sapiens
acgtcatttgggcaggaacttgaattcccgtcgcagtactctgcaaggtcacattcatttccttcctgcctacacacgt

SEQ ID NO: 4351 - DNA, 87 bp, Homo sapiens
catgtaaatcacttacaaaaataccccaaatgggataaagctgctcatccctgatttttctcatttggttgtaggagttgaaacatg

SEQ ID NO: 4352 - DNA, 90 bp, Homo sapiens
gtggagctgttttctggtcccagagggagagagaaagcccaggaaatctcactttctccctgcccctgggtctccaggcaacggcaccac

SEQ ID NO: 4353 - DNA, 88 bp, Homo sapiens
gaactttagctttggtctatgaaaaggttttgctgaatcttgtgggaacataaacattcggcagatttctttccctgaaagctatttc

SEQ ID NO: 4354 - DNA, 86 bp, Homo sapiens
tcttctgcaatcttggaacttatttaagttttcctgagttaaaaaatgccactgaggggatacaaatagtgtcagggttgggaaga

SEQ ID NO: 4355 - DNA, 83 bp, Homo sapiens
ggcgggggccgggcggcggctgcttatctgcgtttggcatcacctgcaagcgatacaccgaggggccgcaacgagcccccgct

SEQ ID NO: 4356 - DNA, 81 bp, Homo sapiens
ctggcaaggaaagttctaatttttcttttcctattgatgtcttttgcctcattagttgagaaatcaaagagtccttgccag

SEQ ID NO: 4357 - DNA, 78 bp, Homo sapiens
gaatctcagagttttcagaaagattttggaacataaaagatatgtgcttaagataaaacttgaattttgctgagactc

SEQ ID NO: 4358 - DNA, 79 bp, Homo sapiens
gtgtttaatgtttttctgtttatttctgtcttgatggttcctcgagggctttgatgatcagggcagaggcagaaggcac

SEQ ID NO: 4359 - DNA, 76 bp, Homo sapiens
tatgaactgcttaggtagtaagcagttattcctaaatttgtcagtgaataactattgctaaatgggaaagttggtg

SEQ ID NO: 4360 - DNA, 82 bp, Homo sapiens
tcatttacacttgttattacccaggggcatttcaaactgttactgaaatgcatccatccctggagtaaccatctgtgaatgg

SEQ ID NO: 4361 - DNA, 71 bp, Homo sapiens
tataaatctgagtttgttgcatctaccagtgtctagcaagggtggaaagcaaaggcacactcgggtttatg

SEQ ID NO: 4362 - DNA, 87 bp, Homo sapiens
tctcatcccagcctgaaggagggagagcctttgaagccacagacaggctgaacagaactttccacctgagagacgctggagatggga

SEQ ID NO: 4363 - DNA, 61 bp, Homo sapiens
tgcatgttaacaagatttatatacattactggtgccgttaaggaaacttaaatgacttgca

SEQ ID NO: 4364 - DNA, 89 bp, Homo sapiens
cagttgtttatgattcactatattgctcatctggttcttggtggcatttgaattaagatgttttatagactggtgatcatcgagaactg

SEQ ID NO: 4365 - DNA, 69 bp, Homo sapiens
ggctttgtatttttgaattttgtgaaacaaagctatgtttgtaaacacatttcaaaaaatataaatgcc

SEQ ID NO: 4366 - DNA, 77 bp, Homo sapiens
gttaacgtttgatgaagaatcagtagtgcatatgaaagaactttcactgctgaaatatcttttaattaaaaattagc

SEQ ID NO: 4367 - DNA, 71 bp, Homo sapiens
gcagctcgggaggtcggcccgccccctcaaaggctccgggcgggcccgggacctggagggcccgagctagc

SEQ ID NO: 4368 - DNA, 74 bp, Homo sapiens
ttctctccactgtacatggggtactcctttcggccattgggcccttccagtaccatgatgtcaaaaggagagga

SEQ ID NO: 4369 - DNA, 83 bp, Homo sapiens
ggattggagtcattaatatcctaggcaagaaacatggaagtgaagacttctttctctgcaagggaaaccgatgatcccactcc

SEQ ID NO: 4370 - DNA, 70 bp, Homo sapiens
attgtcctttctataagcttgtcactgcaaaaagttgccttttgcttgtcaggtttggatagaatataat

SEQ ID NO: 4371 - DNA, 67 bp, Homo sapiens
gggctggggcaggctggcctttcccgtgttcccagtccctgggagggggaatgttggcctggagccc

SEQ ID NO: 4372 - DNA, 86 bp, Homo sapiens
gctgttgattttccttttcctgctgacctcagtcttataccttaagtaagtgagaccaggtatgcatattaaggaatttctgtagt

SEQ ID NO: 4373 - DNA, 68 bp, Homo sapiens
gcctgctcatcagtgcgagcggaaggcaggctgtggtagttgggctcggctccattgagagctttggt

SEQ ID NO: 4374 - DNA, 85 bp, Homo sapiens
atttggccaactctctttgggcagctcaattttcatcctagctcactggcctgaaaatgaagctgtcaagagtcctaggttgaat

SEQ ID NO: 4375 - DNA, 74 bp, Homo sapiens
tggaaagctcacaatgtctggttggggtgactttaaatggaatgtcaccccagtgacacttttgtggctttcca

SEQ ID NO: 4376 - DNA, 88 bp, Homo sapiens
ggtggagactgagcttaggaaaaggcttcttcatgaaggataaaatccttgaccgagagccactcttcttcatgtgctcatcaccact

SEQ ID NO: 4377 - DNA, 75 bp, Homo sapiens
atcttaaccaccatcaaatgttttccacacagaataggcagacctagtttattctggaaaattgagggtttggat

SEQ ID NO: 4378 - DNA, 61 bp, Homo sapiens
agcggcgcatctggagcgggcgtcgcgggacgcgtgtggggcggctcctgcccgcgccgcc

SEQ ID NO: 4379 - DNA, 79 bp, Homo sapiens
cacacacacggtatactgtgtctggcagctcatcaagaaggtggaagcagcctggcaacatagtatctgtgaaagtgtg

SEQ ID NO: 4380 - DNA, 83 bp, Homo sapiens
tgagcagtaatgactgaggtgtgagccacttccccaggattaataaagagccggggagttgacagtttagaccattaggctta

SEQ ID NO: 4381 - DNA, 75 bp, Homo sapiens
cccctatcaggctgtccgggaagaaggcccgttgcctctgcagcgtcagcatttttccagggcctaaaatagggg

SEQ ID NO: 4382 - DNA, 86 bp, Homo sapiens
ccaagttaacttagctatggccagtgtcaccaagtaaagccatacttgaatgagatgacgactggatacaaagctggtgaactggg

SEQ ID NO: 4383 - DNA, 79 bp, Homo sapiens
gctgggcctggcaggcgggcctgtgggggcgcccctgggctccatgacctacagcgcctctctgcccctcccgctcagc

SEQ ID NO: 4384 - DNA, 82 bp, Homo sapiens
tccgggccttgcgccccttctccaccgccagcttggccttgtctgggctgctggggtcgggaccgcgggcgccaggcgtggg

SEQ ID NO: 4385 - DNA, 87 bp, Homo sapiens
ggcaattggaatgtcaattttatttagtactatgttgtaaaaactaaacagcatatccagctgattgacaaaatccatccaactgtt

SEQ ID NO: 4386 - DNA, 76 bp, Homo sapiens
gcgcccgccgggagcagcgagaccgggagcccgccgtctgcggagcctggcctcgcggctcccacgcggcgggcgc

SEQ ID NO: 4387 - DNA, 71 bp, Homo sapiens
atgacgtgccctcctgcccagagttaccagtatcgctaggctggcaacaagtcttaggaagtttacgtcat

SEQ ID NO: 4388 - DNA, 72 bp, Homo sapiens
cattgaaggtgggggctccaccgatgctcttcgtttgaagatgcacggtcagttccccatcctgcagcagtg

SEQ ID NO: 4389 - DNA, 72 bp, Homo sapiens
atttataggagttttaaatgacaagccttttctaaattccaaaaggctttaaaaatttgcattcctataaat

SEQ ID NO: 4390 - DNA, 61 bp, Homo sapiens
agctggacagaatgctcagagcaaagcaggtgctgaccatacagcacatggttttcctgcc

SEQ ID NO: 4391 - DNA, 78 bp, Homo sapiens
tcatacacaaatttagaaatgcatgatgaagcctagtacagcatatgtatgagacacattttttaagtttgtgttaga

SEQ ID NO: 4392 - DNA, 79 bp, Homo sapiens
acaggagagactgctgtttacctacgtactgaagggtaactgctgcccgcgtaattaaatcagtattgtcctttcctgt

SEQ ID NO: 4393 - DNA, 75 bp, Homo sapiens
cagaacaggtctaattttcattaagcatgactacagttttcctacactaatcatattaatgttatacttgttttg

SEQ ID NO: 4394 - DNA, 77 bp, Homo sapiens
ctctttcaggccacttagggaccaattagtgcattatgctaaggggtactaaattgtatcctactggcttggaggag

SEQ ID NO: 4395 - DNA, 62 bp, Homo sapiens
atgaggaaagagttatttggggggtctcagtttgccccaaaatggatcaccatttttctcat

SEQ ID NO: 4396 - DNA, 62 bp, Homo sapiens
agctggacagtgtggttgacctcactggggtcccagagccctccagcctcatccgtgctgac

SEQ ID NO: 4397 - DNA, 61 bp, Homo sapiens
ccttctaagaaaggatttcttggcaggagtcaagatttttccagaaccttttttacggagg

SEQ ID NO: 4398 - DNA, 60 bp, Homo sapiens
agcaggacatcgattttgcctgtcttctaatcttattatgaggcgaatttatgttctgtc

SEQ ID NO: 4399 - DNA, 60 bp, Homo sapiens
ctctctgtttccatggagaagtatgtcagtgatgtgtttgactccatggaaacagatgag

SEQ ID NO: 4400 - DNA, 60 bp, Homo sapiens
aattacaaagtattgttcacttcacaaaataaaaccatttccagataattttttgacagt

SEQ ID NO: 4401 - DNA, 73 bp, Homo sapiens
tcccaggtggcactggtagagttctcatcccctgtccccgtggaaccccggtatacctgggccatgctctcgg

SEQ ID NO: 4402 - DNA, 86 bp, Homo sapiens
ttaaggcagcaggtggcttttaatgagatcttgaaacagaactgttccctctatgtccaatcaaaatccacactttgctgccttga

SEQ ID NO: 4403 - DNA, 76 bp, Homo sapiens
gatagagtttataaaacagtcctgtgtaaactgctggaagttcttccacagtcaggtcaattttgtcaaacccttc

SEQ ID NO: 4404 - DNA, 61 bp, Homo sapiens
aggaaaagaaaaaaatttaaagtgaaggttaacgttccattcaaatttatcttgtgatgcc

SEQ ID NO: 4405 - DNA, 70 bp, Homo sapiens
attgccttgactccactctttccccggtgggtggagacacagctgggctaagagtagaggccaagccaat

SEQ ID NO: 4406 - DNA, 89 bp, Homo sapiens
atagaattctcaggaaattattcagctgctctaagatgggaagcagggacgagtgttctctcttcagcttagttctctgtgatttctgt

SEQ ID NO: 4407 - DNA, 82 bp, Homo sapiens
agagcacaccgtgagcccccgtcggccattctgtggtgttttaatattgcgatggtttatgggacgttttaagtgttgttct

SEQ ID NO: 4408 - DNA, 68 bp, Homo sapiens
ctgtgtggatttggtctatagccacagatttgtgactaaatggctgtgtgatcgaaactactaaacag

SEQ ID NO: 4409 - DNA, 86 bp, Homo sapiens
gccttctttcttccagcgcccgctttaaattggctaggtctgagcttttccagatgccagtggggaggggcgtgtgcgttagaggc

SEQ ID NO: 4410 - DNA, 74 bp, Homo sapiens
gccaggccagtcccctgagccttcgccggccccgggtccgggccgtcgcgggggccgcggggagctggcccggc

SEQ ID NO: 4411 - DNA, 83 bp, Homo sapiens
ctgtttggatggcgctcaaagatagaaccaggccatattcttggccttggtggaactatatctagattgctccagccagatgg

SEQ ID NO: 4412 - DNA, 82 bp, Homo sapiens
gcttttttgccaacctgagtcgggatgcggaggatattgggggtttcttccatgaccctgacaagcaggttgtcaatgtagt

SEQ ID NO: 4413 - DNA, 79 bp, Homo sapiens
cgctgtggctgccgaagcccccggtgaggccgcggtagcaggagatgccacggtagggggcggcggtgatgcagcagcg

SEQ ID NO: 4414 - DNA, 81 bp, Homo sapiens
tcttgagtctgagtgtgctgtagaatgtcttgctgtaaatgtttgaatacagctatacagatatacacttgataatcagga

SEQ ID NO: 4415 - DNA, 84 bp, Homo sapiens
gttatatgtaaggctctttcaacgtaaattaagctggattaagatgaccaaattagagtatgaagagattgccttagacttaac

SEQ ID NO: 4416 - DNA, 89 bp, Homo sapiens
ggcaggcgggggcaggcaggcaggcagtgcacacttgcgatcattcacattgcaggcgtcacatggctctgtctccgccccagtgggcc

SEQ ID NO: 4417 - DNA, 82 bp, Homo sapiens
cttggctcattgaatcgcctgcctgtcaaactgttatttaaatttgacttttaagtaaggcgctttggaaaattgagctaag

SEQ ID NO: 4418 - DNA, 82 bp, Homo sapiens
gggacggtttgaggaccgggctcggccgaggagactccaaccttcaccctccctggcccccggtcccacttcccgccgtctc

SEQ ID NO: 4419 - DNA, 80 bp, Homo sapiens
gcacattagagaaatgccagctgaaagaaactcagagttacaagtgtgggtttcagcagcctccatactctttaggatgc

SEQ ID NO: 4420 - DNA, 71 bp, Homo sapiens
agcatccatcatttgaagtaaaacagcatttgctttcttctggcggaggttgttgcttggagtgatgtgct

SEQ ID NO: 4421 - DNA, 69 bp, Homo sapiens
ttctggagacctcttcactgcccacaatttcagcgagcagtcgcggattgggagcagcgagctccagga

SEQ ID NO: 4422 - DNA, 87 bp, Homo sapiens
ctgagtgactgggagaagctttcttctcttcatagtgtgtgtactcgctgactatgtccatgtcagagcaggcttccagttcatcag

SEQ ID NO: 4423 - DNA, 74 bp, Homo sapiens
agcatcacctagcacttacactatgtttggttttccattttcaaagtgctttgcaatgagtgactagctgagct

SEQ ID NO: 4424 - DNA, 75 bp, Homo sapiens
gaggaggccctggggggcggccagcccaatgctgccaggtctgcttgcagacaaggcctggctgtctgcctcctc

SEQ ID NO: 4425 - DNA, 74 bp, Homo sapiens
agaatcggagtcagatgtgtctctgtatgctgaactagtcatttctacatcagttgaggcgcgactccttttct

SEQ ID NO: 4426 - DNA, 78 bp, Homo sapiens
tgtatttttcacccaagaaatttcagatttcaacagaagaccaattctcctggataatgatgttgatggggaagtgca

SEQ ID NO: 4427 - DNA, 86 bp, Homo sapiens
ctggggaagcctgagcgcacatggagcccgtccacgttctggctgaccaggaagcggaggaggcccacgcgctccagctgcaccag

SEQ ID NO: 4428 - DNA, 76 bp, Homo sapiens
gtagcaaaagtgctcattttcagagaaagatgctgaggaaaagcatctctgaactcctcgatagaacttttgctat

SEQ ID NO: 4429 - DNA, 67 bp, Homo sapiens
ctcccctttcttgacggctcaataggtcattagccacaggcccattgagtgcttttaaaagggggag

SEQ ID NO: 4430 - DNA, 64 bp, Homo sapiens
gcctgcatttcagttcttgtttctttgaaaggacctgtcagggaagcagtatgaaatgtcaggt

SEQ ID NO: 4431 - DNA, 89 bp, Homo sapiens
gcagcatgagcccactggctcccaggaggtccttctgtgtctccacagcatcaatggcaccatcactgagggcgccatgggccacctgc

SEQ ID NO: 4432 - DNA, 71 bp, Homo sapiens
cagcatctgtctgggtggaacatagttgtggtcatggctacattactaacctctcactcagtcatttgttg

SEQ ID NO: 4433 - DNA, 86 bp, Homo sapiens
tcgatgtttatttgtaggactttaagacaataacagatatcagctatatcatctgtttttgattataaactcctagagggcaacga

SEQ ID NO: 4434 - DNA, 74 bp, Homo sapiens
agttgttcaattgttttaatgagtcttgaatccactggattaagtgaaaattcatctgatttaattgagtgact

SEQ ID NO: 4435 - DNA, 90 bp, Homo sapiens
atgcagtatcgtttgttaccaccagagaatacaaaatataaaggcacattgcatctcttattctttgggggtgactggggagatctgtat

SEQ ID NO: 4436 - DNA, 86 bp, Homo sapiens
cgccactctcatagtcctacacaaaccctctgttgctcttctattagaccatgctaaccaattctgagggctgtgaggggtaggtg

SEQ ID NO: 4437 - DNA, 71 bp, Homo sapiens
cacgctgcagcacactctcgcccttcacgccacgctcccgagtgtcggtggcggagtcgatgctgctcgtg

SEQ ID NO: 4438 - DNA, 67 bp, Homo sapiens
cgggtaaaggtcgccctcaaggtgacccgcctactttgcgggatgcctgggagttgcgatctgcccg

SEQ ID NO: 4439 - DNA, 66 bp, Homo sapiens
catgtacttacatgcagatgtacacatgactgaatggatgtacatgtgtctgtgagtgtagacatg

SEQ ID NO: 4440 - DNA, 66 bp, Homo sapiens
gtcctggcccactatgccagcatctgccagcagaatggcattgtgctcatcgtggagcctgaggat

SEQ ID NO: 4441 - DNA, 82 bp, Homo sapiens
gtgactcctgcactaagagccataggaaatattgtcactggtacagatggacagactcaggttgttattgatgcaggagcac

SEQ ID NO: 4442 - DNA, 65 bp, Homo sapiens
tggaggccaccagggcaccattagcacatagcagcaattattgactaaatggtgctctggttcca

SEQ ID NO: 4443 - DNA, 81 bp, Homo sapiens
aaggctttagggatttggggaggtggatggagaacaggttcttatctaggctttagcacaatattccttcttcaaagtctt

SEQ ID NO: 4444 - DNA, 77 bp, Homo sapiens
gctctacgtatctgtttggttttcacactgtagatgacagggttcatcaaaggggagatcagcaggtaggtgttagc

SEQ ID NO: 4445 - DNA, 72 bp, Homo sapiens
ctcaagatggcgggccagggataggggagagaggaggcgggcacctccctctcctggccaggcaggcatgag

SEQ ID NO: 4446 - DNA, 67 bp, Homo sapiens
ggcagtctgcactgtctctccatcattagtgtttactgagctgatggagaccgcagtcaggcctgct

SEQ ID NO: 4447 - DNA, 70 bp, Homo sapiens
ggggttggacccggccgcggcggctataaaagggccggcgccctggtgctgccgcagtgcctcccgcccc

SEQ ID NO: 4448 - DNA, 79 bp, Homo sapiens
ctgcagtacaatgaagctctagattgggtcatgctcactggccaccacatggtccaacatgtgagctgaaaaactgcag

SEQ ID NO: 4449 - DNA, 71 bp, Homo sapiens
gttgacatacatcacaaactattcattttttcatgtccagtaattatgaaaagcattggagtcatgtcaac

SEQ ID NO: 4450 - DNA, 68 bp, Homo sapiens
ctgttttacaagtggtttaatcccatgggtagtgtggttataatccagatgagcctcttgaggggcag

SEQ ID NO: 4451 - DNA, 60 bp, Homo sapiens
gtcaccagggtaccatttggtaaattgctgctgcaaagcagtgaatagtaccctggtggc

SEQ ID NO: 4452 - DNA, 67 bp, Homo sapiens
ttcactttgaaaatagtcagcaaaatccttatttccataagcatttttctggctgtaaaaagctgaa

SEQ ID NO: 4453 - DNA, 79 bp, Homo sapiens
gccaggttgccctgctgcattactaaagcgggactggttctggaagcccatttgcttagtaaacagcgggcagcattgc

SEQ ID NO: 4454 - DNA, 75 bp, Homo sapiens
ggaagggggccgcctccccgtggggctcctggctgcctctgctcccttggacaccactggggggcctccccctcc

SEQ ID NO: 4455 - DNA, 82 bp, Homo sapiens
tattgattaagttgttccagtttctagaattgttgcacagttctctggatggtggtgtctggggactgggactccttcaata

SEQ ID NO: 4456 - DNA, 81 bp, Homo sapiens
tcttctttctgttcaatgctgattattctccagaaggctcttctagcttcaatcacattgttatatgaaacagataggagg

SEQ ID NO: 4457 - DNA, 64 bp, Homo sapiens
gggctcccggctgggtcccgcttggcagctcgcggcggcggggaggcggggccggcgggagccc

SEQ ID NO: 4458 - DNA, 86 bp, Homo sapiens
aagcaatttggtccctctgttctaaactgtgcaggggtaaaaggctctgcaaagaagtgaactgggcatttagaagcaagttgctt

SEQ ID NO: 4459 - DNA, 77 bp, Homo sapiens
gcaccgcgggtgctgtaccccagctctggagcgcaatggcttcgcgctcttggatatggtgctgcacgccgcggagc

SEQ ID NO: 4460 - DNA, 79 bp, Homo sapiens
cagcttggcaatgagagccacagacttgggagccaggacattgcctccccagtgatgatggatctcatcgtatctgctg

SEQ ID NO: 4461 - DNA, 79 bp, Homo sapiens
ggcctgggagctgtagtccggagcttcagggccagccaggaagcccgggggcctgtaggactacaactcccagaaggcc

SEQ ID NO: 4462 - DNA, 85 bp, Homo sapiens
ggcttgcagcagttatacttaaaggcaattaaacttagatagcatgcagttcttgccttggtggtaaactactgcaatgcaagct

SEQ ID NO: 4463 - DNA, 73 bp, Homo sapiens
tctttaagccaagttctttctagacatttgtgtaattctagatttatggccaagaaaaaatttggctacaagg

SEQ ID NO: 4464 - DNA, 84 bp, Homo sapiens
cctgctccacccaagctccctccacatctgatggggctctggggccctcagagctggatgcagggagctgggggctggagcagg

SEQ ID NO: 4465 - DNA, 72 bp, Homo sapiens
gtgctagggagagtggggcttggggccacatggggttctgctgtgtctggtaccaagccatcccctggccac

SEQ ID NO: 4466 - DNA, 90 bp, Homo sapiens
caaaacttggcttgaaactgctgcaatgcattctttctttgtgtatcagaatgcaatgagggacaaagtgataggagttgtcaagttttg

SEQ ID NO: 4467 - DNA, 67 bp, Homo sapiens
cactttttctctgaagtgtaaagaaaattttggtgaattgctttacgctcaaatagagaaatcagtg

SEQ ID NO: 4468 - DNA, 61 bp, Homo sapiens
agtggcagaccatgattgaagcttatgttgatgtcaagactatcagtgattatttgctttg

SEQ ID NO: 4469 - DNA, 76 bp, Homo sapiens
agtgttcagtgaggcccaacagtgcaaggtggcaggagggctgtaggctccttgccgtgggccaggcactgccact

SEQ ID NO: 4470 - DNA, 89 bp, Homo sapiens
gaacacaacttatttgactttctgtggtcctcttgaaggtgattaatcaccaattttagagcaccaagaattgcacaatattaatgttt

SEQ ID NO: 4471 - DNA, 68 bp, Homo sapiens
gatttagatgtttaatagaaagtaaacgtttgacttgctttggtttctgctgaacctgtatttaaatc

SEQ ID NO: 4472 - DNA, 83 bp, Homo sapiens
gtcttggaggggagggaggagggagaccggtaggaagatgttttcctgcctcccacctccccctagatgcaccctccgaaagc

SEQ ID NO: 4473 - DNA, 60 bp, Homo sapiens
agctgcaggccaaaatggagagaaactgactccctcctccacacatcctgacttgctgcc

SEQ ID NO: 4474 - DNA, 70 bp, Homo sapiens
ccgaaataggcagtgattagtgagcaatctgtgttgatgtaacaagcacatcaccattgtttgtttctgg

SEQ ID NO: 4475 - DNA, 78 bp, Homo sapiens
tcactgctcaggtgaggggatcagcctttgatgctttcaacatcagaacatcagagctgctcttcatcctgagaagga

SEQ ID NO: 4476 - DNA, 75 bp, Homo sapiens
ttggctttatagtctggtgtacagacgtggctatttttccccatagctctcaggtcagtgcatcctcaaagccaa

SEQ ID NO: 4477 - DNA, 80 bp, Homo sapiens
atctagaaggtgaataatgaaaacctcaagcctgttgatttataaacaggcccagaattctgtgttctttaacctcagat

SEQ ID NO: 4478 - DNA, 65 bp, Homo sapiens
tttactgtagagatattgacaaaggaattaatttaagtactttaagtcaatattactttagtgga

SEQ ID NO: 4479 - DNA, 82 bp, Homo sapiens
tctagtgactgattagatactgatgttggagttaaaaggaggaccagagataactgtcaacatgggatcctgagtgactgga

SEQ ID NO: 4480 - DNA, 63 bp, Homo sapiens
ggccctggggttggtagggcagctggtagaggagtaccagctggtgtgccaattccccaggcc

SEQ ID NO: 4481 - DNA, 75 bp, Homo sapiens
ggtcagctcagtgtgatactctgagttcagagagtgggacaccattcacttagagtggcatttgggcatcttgcc

SEQ ID NO: 4482 - DNA, 69 bp, Homo sapiens
catatgcttggcctgaccttggatgttctgtggtcatcatggatgttggacagaaggccgtggcatgtg

SEQ ID NO: 4483 - DNA, 75 bp, Homo sapiens
tgtcatgacaaagacagggtggtatttttaaagtgacaaacttcataaaaattttacacattcttttctatggca

SEQ ID NO: 4484 - DNA, 85 bp, Homo sapiens
ttccgaggggactttgtgatggattaccccaggccgatcatgcccaacatggtcttcattgggggcatcaactgtgccaacggga

SEQ ID NO: 4485 - DNA, 71 bp, Homo sapiens
tttctggacacagtggtggctttgttacaggggcacctgctgctgtaagccatacccaaatgtccctgaga

SEQ ID NO: 4486 - DNA, 72 bp, Homo sapiens
tcaatacaaataggaaaaggtcttttaatgactatgatatatcaaagatctgaaaggctttctctgtattga

SEQ ID NO: 4487 - DNA, 77 bp, Homo sapiens
ttccacatcatcttcagccaagctctgagcacttagaattctctaattgttgggagcttagtcaaaagcatctggaa

SEQ ID NO: 4488 - DNA, 70 bp, Homo sapiens
actgctatataatgcaaatggctgcaatctcattgttttctgctattgtttattgcaaatatatagtagt

SEQ ID NO: 4489 - DNA, 83 bp, Homo sapiens
ttattgaggtttcactaataagcagcttctacttttgagcctcaacttaaagcagaactgttttctactggatttttcattaa

SEQ ID NO: 4490 - DNA, 71 bp, Homo sapiens
ttgtggattaagtgtggcaaatggtgaagtttaggccaccctgtgcatctgttcatttgctcactacacga

SEQ ID NO: 4491 - DNA, 81 bp, Homo sapiens
gggaggcctggatttttgtctgtttgtttctcctaggtctcttcctcacttaagtgaccttggacaaatccatttcttccc

SEQ ID NO: 4492 - DNA, 85 bp, Homo sapiens
cctcgcctgctcctcctgtccccactcctccttgccccacccaatttgggggctggagaggggacaggatgggccaaggacaagg

SEQ ID NO: 4493 - DNA, 71 bp, Homo sapiens
ggaagcttggagtgggtggcatatcacagccctggaccagaggtcaggtatttggccttttcctggcttcc

SEQ ID NO: 4494 - DNA, 88 bp, Homo sapiens
atgttgcagagtacatacactacttaatggaagatgcttacaagaaagagttctctcaatacataaagaatagtgtaactccagacat

SEQ ID NO: 4495 - DNA, 82 bp, Homo sapiens
attacagggacaaaatgatttgatgcaggaaccaagcagacatctgggttccagttagcatctgacatggggccttgctaat

SEQ ID NO: 4496 - DNA, 85 bp, Homo sapiens
tgtttaagctctggtttagctgtaaatcatttgtgaagatcatttcttggtaggtgagtggaattgctattatagagtgttaata

SEQ ID NO: 4497 - DNA, 74 bp, Homo sapiens
ataatgtaagatttttgcagtattttaagatcttttgatagactaattatattgcaaaaggttgattgcattat

SEQ ID NO: 4498 - DNA, 83 bp, Homo sapiens
gtcatcttgtgttgcattctttgacattccatgatttggataatttctagtatccaaagatcttacacaaaaactcagatgac

SEQ ID NO: 4499 - DNA, 82 bp, Homo sapiens
agcaaatttactattgggaataaatatttgatgcaggtgaacacctgctaaatagatattatgttttaatatattgttagct

SEQ ID NO: 4500 - DNA, 81 bp, Homo sapiens
ggaagcttgaaattggggatacttagaagagttacccagagttatatttttgttttacaattttattccccaatagcttcc

SEQ ID NO: 4501 - DNA, 86 bp, Homo sapiens
tcttaagagaagtaggtcttaacaagttgtgactacctggcattaaataaaagtagtcacatcacggattcaattttctcttaaga

SEQ ID NO: 4502 - DNA, 85 bp, Homo sapiens
gccatgtctccttccagctgtttgcaaagttccaaagacaacagaaaatgttcattttgtgagcactggagagaaaggatttggc

SEQ ID NO: 4503 - DNA, 79 bp, Homo sapiens
ggattaatctctgagaacaagtgctcttgtttcttagtggaaaaacagagaagcttttgatttccatgagataagatcc

SEQ ID NO: 4504 - DNA, 60 bp, Homo sapiens
agaagaaaatgaagctggggaccaaggtgggtcccatctccccagcttgctgctcctgcc

SEQ ID NO: 4505 - DNA, 71 bp, Homo sapiens
tcagttaaattaatgcccaaggcttcagggtgaacggtcttctggagagaacgtgggcatttattttcgga

SEQ ID NO: 4506 - DNA, 64 bp, Homo sapiens
ggggactacaactcccaaggtacatacaaagcaattgtggtgcacactgggagttgtagtcctt

SEQ ID NO: 4507 - DNA, 78 bp, Homo sapiens
ttctatccgaaggaaacactgaactttgtagtgttagcagcagctgaaatttagaattattgtttccttctaacagaa

SEQ ID NO: 4508 - DNA, 70 bp, Homo sapiens
gaaatttcagtcttgtaaagttcattctgtttttatgctagcctgagaaatttgctgacaatgaaatttc

SEQ ID NO: 4509 - DNA, 78 bp, Homo sapiens
gtggttgccttgctaatgtaatttaggatgcattagtcaatgtttctcaggctgttcatcctagatcagggtaattat

SEQ ID NO: 4510 - DNA, 71 bp, Homo sapiens
attttctgtagtattttaacactgcatttctgtacaagggaattgtaaagtgcaagaatatgagagaagat

SEQ ID NO: 4511 - DNA, 76 bp, Homo sapiens
gggagaccgggaacattcctcgggtgctcaaattccagtggatttatctgagcttaaggaatattctctgtttcct

SEQ ID NO: 4512 - DNA, 79 bp, Homo sapiens
ggagggcgggggagagacgagcggctctggccccttaattgtacttcgggctcgtattgtctctcctttcgccacctcc

SEQ ID NO: 4513 - DNA, 75 bp, Homo sapiens
catccagggatttgtagttcccttacggccaccaagtgcacttagggcaggcctcttactacgagtcccgtgatg

SEQ ID NO: 4514 - DNA, 76 bp, Homo sapiens
gcagctgggcggaggacgtgggtgtgggatgcactgtgcattccttctcctcactcttgttcctttgagcagctgc

SEQ ID NO: 4515 - DNA, 61 bp, Homo sapiens
ctcattaaatattaccttgggcctaacattaaaaatgatgaggctcagtaatcttaatgag

SEQ ID NO: 4516 - DNA, 64 bp, Homo sapiens
taagaaagctcagctggtggtgattgcacatgacgtggatcccattgagctggtcgtcttcttg

SEQ ID NO: 4517 - DNA, 90 bp, Homo sapiens
atcttgaaggaaattcaaaggtcttgacttctgctgaaaagctaattacctttattttttgctgaccttttcatttcctttctacaagat

SEQ ID NO: 4518 - DNA, 67 bp, Homo sapiens
accggggactgcagctccagaagcatgatgtcatggtcgtggttcaggtgggtggggcttctccggt

SEQ ID NO: 4519 - DNA, 84 bp, Homo sapiens
ctgtagtcaggctgcataaatattcctgagctttggctttctgcaccaaactctcctgagaatagcataggcagtagattgcag

SEQ ID NO: 4520 - DNA, 67 bp, Homo sapiens
ggaggactcgtgggccatggccttgtagagcttgcaggccaccagggccttggccatgctctcttcc

SEQ ID NO: 4521 - DNA, 75 bp, Homo sapiens; identical to SEQ ID NO: 4377

SEQ ID NO: 4522 - DNA, 68 bp, Homo sapiens
cctcagcagggtgcccggaagctggaaccttgttatctgggtaattagtttcagaccctgcactgagg

SEQ ID NO: 4523 - DNA, 85 bp, Homo sapiens
gcagtctgggagctgatacaaatggagccgggtgcaatttggggagatttgttacgctcagctcccttctatcaattccagctgc

SEQ ID NO: 4524 - DNA, 75 bp, Homo sapiens
ttattcttttgcagtagggccttccattaggtatttgttttgttgacatgtgaatgctcttttgtcaaagattaa

SEQ ID NO: 4525 - DNA, 87 bp, Homo sapiens
tatagaggcaggtttctaaggctttcactgggggaatcatcttgcatttccttttagtgacgttagctcctctggaagcactttata

SEQ ID NO: 4526 - DNA, 81 bp, Homo sapiens
gaatggagtaggcactctaagtaggaatttccatgcttttgtgagtttaatgttcctttaacatagagagcagctgtgttt

SEQ ID NO: 4527 - DNA, 68 bp, Homo sapiens
gggcatccaggggcctgagtcctcactggtcggggacctggatgggtgatgagtaggttcagatgtcc

SEQ ID NO: 4528 - DNA, 90 bp, Homo sapiens
taacgctaatgaaacagaagtcaggcttggaaccttgaaccttgtttagtgactaattccagccactttctgtgatcattacctgtgttg

SEQ ID NO: 4529 - DNA, 82 bp, Homo sapiens
agaagttgccagaaattaaaatgtgcaaaggataaatacaaatctttctcctttgcaatgttggagagatcttgcttctttt

SEQ ID NO: 4530 - DNA, 69 bp, Homo sapiens
tcgggatgcattaacgggctctctttcagaaagactatttctttaagaaagaaccatggtgtgttgtga

SEQ ID NO: 4531 - DNA, 72 bp, Homo sapiens
agtcttttgctgagcgcctgcgcctgggaattgcagtgattcatggagaggcgcaggatgccgagtcggact

SEQ ID NO: 4532 - DNA, 90 bp, Homo sapiens
ctgtggcagtctgtcttggtaaaatctgtgtttcttttgccacattttctggactctgaggcacagctttgataaagaaatctgccacag

SEQ ID NO: 4533 - DNA, 88 bp, Homo sapiens
gcaaacaagaaagaagaactgggaagtctttgtccctaggaaatccaaaggggctggaatatggtgttggtttggctttctggttggc

SEQ ID NO: 4534 - DNA, 74 bp, Homo sapiens
gatgaaatatatattgtaaagaagggatattaagaatcttagataacttcttgaaaaagatggcttatgtcatc

SEQ ID NO: 4535 - DNA, 82 bp, Homo sapiens
gagtgaggctgaaaggagttcacgcattaaattacattttcagtgttctgttccaaacgtatgctcctttacaactttattt

SEQ ID NO: 4536 - DNA, 70 bp, Homo sapiens
gcgcggccagcagggacgccctgggggcgaggtgcagcctccggcctttactggtgtactgcaggccgcc

SEQ ID NO: 4537 - DNA, 85 bp, Homo sapiens
cacgtgacccgtagtgttgtggtctggcccgcgtgggtggcgggagcgccgagagggcgggggcggcgatggggcgggtcacgtg

SEQ ID NO: 4538 - DNA, 75 bp, Homo sapiens
ggctcaggaacagcagcagcccgggccgcgccggcaggaagcgaggcccatgttgctgctgttccctggcgcgcc

SEQ ID NO: 4539 - DNA, 75 bp, Homo sapiens
cctgggttaatgtttgatcctcactggcagttgtgattcatatttgctgccctttgaggtgcttatgttttcagg

SEQ ID NO: 4540 - DNA, 73 bp, Homo sapiens
aggttatgtgttatagccatgtaggaactctggatatcagaactttcactttttggctgtgccaggtaaacct

SEQ ID NO: 4541 - DNA, 78 bp, Homo sapiens
tgagccatctgtgacatatacacattgtgctgggaccatctgcaatgttcctaatctaatggtttaaatgatggctca

SEQ ID NO: 4542 - DNA, 90 bp, Homo sapiens
aacagctttaaaagtggcatttgcagagtgtgatcatacagttatgtactcattcccaaagtgcaaatattgccataatttaacactgtt

SEQ ID NO: 4543 - DNA, 75 bp, Homo sapiens
ctctggggaaagactggagggctgccttgtgttggtttcaaataaatcttcaataggctctttcctcacccagag

SEQ ID NO: 4544 - DNA, 73 bp, Homo sapiens
gcctggagtctggctccgcgctgcgcgccgcgttacataagcggctgcgggcgcgcggccggctaggctcggc

SEQ ID NO: 4545 - DNA, 78 bp, Homo sapiens
gttggggatgccccattcttaaggggttcccctggtaagcataagggggaattcccttgaatatggtagtaccctaac

SEQ ID NO: 4546 - DNA, 88 bp, Homo sapiens
ctttatttttatttttctttccccaacacatctccccaagcgtatggatgctctaggacatgtacttggaaatgcaaaacaaataaag

SEQ ID NO: 4547 - DNA, 69 bp, Homo sapiens
acaggttttcaggaggcctgatctaagggtaaggatatttggctttcagcggatgggcctcctacttgt

SEQ ID NO: 4548 - DNA, 60 bp, Homo sapiens
aaccttacttgaatgttgataggctgttttaattgaagttgacaatattgcctttcagtc

SEQ ID NO: 4549 - DNA, 73 bp, Homo sapiens
gtagtggatgtggctggctgttgtaatgactgcggtcgagattcctctgactgagtcctaaccaatccgctac

SEQ ID NO: 4550 - DNA, 67 bp, Homo sapiens
ggctcaaagggagtcactgctggcaaatatccctctggtatcttgttaacagtaataaccctgagcc

SEQ ID NO: 4551 - DNA, 78 bp, Homo sapiens
gcctaatttggaggaaaaacgttggctgcttttgtgaggcaaagaaatagaacagcaaatgttccttcaaattgcagc

SEQ ID NO: 4552 - DNA, 69 bp, Homo sapiens
ccatgggtgatggggaatcagggttccactctgaagagggagcctgagaaacagctaccacattcaagg

SEQ ID NO: 4553 - DNA, 77 bp, Homo sapiens
ggagagttagagatgaaatgggcaatgaggtggaaggagtcgcagctgtttcttttcattcattcattgaattctct

SEQ ID NO: 4554 - DNA, 61 bp, Homo sapiens
gccctgcgcgccccgggagcgccgtgcggccctgcccgcgggctccgggtgtgcgcggggc

SEQ ID NO: 4555 - DNA, 75 bp, Homo sapiens
ttcctcaccctttgtccttcccaacatccataaattcctttttggaatgtgtcaggaagagagaggagccaggaa

SEQ ID NO: 4556 - DNA, 88 bp, Homo sapiens
agaatcagcttttctactgtattttcaacaaacctgactaaccggcacttttgctgggagatgtttgtcaaagatgctgtaagattct

SEQ ID NO: 4557 - DNA, 80 bp, Homo sapiens
agaatagaagggccagcagagaaggtttcaagatggagggcagatttcagaagctgctttctgcttgtcagctctaggct

SEQ ID NO: 4558 - DNA, 60 bp, Homo sapiens
cacagtaaaaatatatttgcattcttaatgctaattatctgcaagtattttttcattgtg

SEQ ID NO: 4559 - DNA, 77 bp, Homo sapiens
tccatctggcagctccagaggacaacattaatgcactgtctatacagctattgatgtgagcatgagagcagcatgga

SEQ ID NO: 4560 - DNA, 81 bp, Homo sapiens
gtaatgacaggtttggtggcttctcaaggctgggtttaaaaatgacagaggggaagatcatcttggcagaagtgtcattat

SEQ ID NO: 4561 - DNA, 78 bp, Homo sapiens
tcagtccctggttaggaagtaaatatggaagtgcaaaatggcatttttaaacaaaactgctttcctgaccgtaactga

SEQ ID NO: 4562 - DNA, 74 bp, Homo sapiens
cagtgaaagttgactgcctgcatcaatgatgtcttgtttcatcctgaggttcaaggcacagtcaaacatcattg

SEQ ID NO: 4563 - DNA, 66 bp, Homo sapiens
ctggtaaacatgacctggacatttgtaagaatatatttaatatatgtacacccattatgttttcag

SEQ ID NO: 4564 - DNA, 67 bp, Homo sapiens
tagaccctcaaaatacatttaaaagtcaagttattttatttttatttgtgaattgattgtgggttta

SEQ ID NO: 4565 - DNA, 80 bp, Homo sapiens
gtgtacttttgcttaaaatgtgatgtctgaaaataaatgtatagcttttagctttattattagttttgagctagttacat

SEQ ID NO: 4566 - DNA, 82 bp, Homo sapiens
acttgacaaagtcaaaatgctctcctgtcagtgcccatatgaactattacaatgacagaagagcattttaattttgtccagt

SEQ ID NO: 4567 - DNA, 86 bp, Homo sapiens
gggacaggggagaaagatgtgggtggagtctgggaggcagatgcgagaatcagatcacaatgacgagaagccctttcctttgtccc

SEQ ID NO: 4568 - DNA, 73 bp, Homo sapiens
ggccctgcggctaaaaataactctggggcctcaaaaatgggacaccagccaggcccaggggtagctgcaggcc

SEQ ID NO: 4569 - DNA, 77 bp, Homo sapiens
tgtcattcttgaaagttatgggttcgtaattgcagtcacttactgtaattatgcaacacttgctttgagaaaagaca

SEQ ID NO: 4570 - DNA, 80 bp, Homo sapiens
ggaagttttttaatatagtatgtagacacattggtaaaaatcagtatgtccactggcttattagtttcacagatgcttcc

SEQ ID NO: 4571 - DNA, 73 bp, Homo sapiens
gggaggggtgaggcgggtgaggacagaggagtagccaatccaggccctgtgcccctacaccctcacctctttc

SEQ ID NO: 4572 - DNA, 87 bp, Homo sapiens
tgcagtttttcaagactgaaatggtctttaatgaagcaagccatgtgtggcttttcaggcgagcattttcatgcttggttaactgta

SEQ ID NO: 4573 - DNA, 73 bp, Homo sapiens
tggggacaaaggctgtgctgtgcctggccccgggctggcctcaggctggtcatactgagcccttctgtcccca

SEQ ID NO: 4574 - DNA, 89 bp, Homo sapiens
ggaaattgccatgtgcagaatgacttgatagaaaatggtgtacattctatataatcttctaacagcagaatgcgaccagtggcacttcc

SEQ ID NO: 4575 - DNA, 79 bp, Homo sapiens
gggggacccagggagccgtttttccacacttctccttttgtgtggagatagaggccaccccgtggctaatccgtccccc

SEQ ID NO: 4576 - DNA, 75 bp, Homo sapiens
atttttgaaaggtttatagcttattcttgatgtagataaatgttttttagaatacttgttttgcctttcatgaat

SEQ ID NO: 4577 - DNA, 67 bp, Homo sapiens
tcttggcaatgtttaatgccatgtcccctgtcttgctgtcaggggcagctcatctgagctgccaaga

SEQ ID NO: 4578 - DNA, 86 bp, Homo sapiens; identical to SEQ ID NO: 1201

SEQ ID NO: 4579 - DNA, 74 bp, Homo sapiens
gctatatagctatttgcattccttaatcaaattcaagagggtagatgaggaaatgaattcatagctctgtagac

SEQ ID NO: 4580 - DNA, 77 bp, Homo sapiens
gtcttggagggatgggaaaaaggtttttagcagtcagacaggatgctgagacttctctcctgaccttgggccaagac

SEQ ID NO: 4581 - DNA, 77 bp, Homo sapiens
aggcaatcacactcctggggattataggagcttggatacatgtctttccttataatgccctaaggatgtgattatct

SEQ ID NO: 4582 - DNA, 70 bp, Homo sapiens
ctgttcaaatacaaagtatattcattatagtgattgcaattaaaatgaatatcaaatgagtttgtaatag

SEQ ID NO: 4583 - DNA, 76 bp, Homo sapiens
ggagcaaagctttaatggggtctcagcttgattttgccatgtttatatacaaaagagatgaggcaagctttgtttt

SEQ ID NO: 4584 - DNA, 73 bp, Homo sapiens
actatcctataaatatttaaagattctaagatagtacttaagtattactactgaaaatttaagtacaggaagt

SEQ ID NO: 4585 - DNA, 90 bp, Homo sapiens
cagtaaacttgaaagagccatgctgtctagtcttgaagtccctcatttaaacagaggtcaagcagtaggcgcctggcagtgtcaagtctg

SEQ ID NO: 4586 - DNA, 87 bp, Homo sapiens
tgcagcatagatcaggagcttaggggctttccctggtttctgctgataccagcctaaatcatttctaatgccctgacttgcccggca

SEQ ID NO: 4587 - DNA, 80 bp, Homo sapiens
tgctccagcagctggtgctgcaccagtgggatcctgcccactccactgctgctgctccagctgagaagaaagtggaagca

SEQ ID NO: 4588 - DNA, 60 bp, Homo sapiens
accagaacagggaggtggtcactatcaaaataaacacattggtgcctggaatttcctgac

SEQ ID NO: 4589 - DNA, 72 bp, Homo sapiens
tcctttagctagagaaagaaatcattacaactcttttgggcagagatgtttctttttaatgttaatcaaggg

SEQ ID NO: 4590 - DNA, 80 bp, Homo sapiens
gattctcaaaagaaaaccaaaatattcctatggcaacttgatctttgacaaagtagggaagtgttgtaagtttgagagtc

SEQ ID NO: 4591 - DNA, 85 bp, Homo sapiens; identical to SEQ ID NO: 4116

SEQ ID NO: 4592 - DNA, 76 bp, Homo sapiens
acatacctctttggctttggagtagtttaatatgaattaatcactaggctctcttcagagttggaaacgaggtggt

SEQ ID NO: 4593 - DNA, 75 bp, Homo sapiens
aggaataaagaaactgccaacttttttgctggccatgcctgaaagcattaaggttgtaaatagtattttaatcct

SEQ ID NO: 4594 - DNA, 90 bp, Homo sapiens
gcccagctgctcccaccaggggccgtttgaacctctggctcattaccgagcccataaaccaagctggccagaggaatggaggctgctggc

SEQ ID NO: 4595 - DNA, 83 bp, Homo sapiens
tttatgatccacatatcacaaaattatactcacattaaaaataaccatctagtgtacatcattttatgatattggcaaataaa

SEQ ID NO: 4596 - DNA, 79 bp, Homo sapiens
ctcagtgaatatctcttaagcaatgatcagggtttagaaatctatactgaaccaaagcacaggagaatatttttctgag

SEQ ID NO: 4597 - DNA, 67 bp, Homo sapiens
ttgccaacagggaagcttgggctgcagctgcagcagcaggtgctggctgccaggttccctgtggcaa

SEQ ID NO: 4598 - DNA, 67 bp, Homo sapiens
taccatgatcacagtaatgttctttggagatataatcatcaaagagcatcccttggttagtgtggta

SEQ ID NO: 4599 - DNA, 78 bp, Homo sapiens
tctgcatcctgtcagcaatgcctggatacatggtggtgccaccggatagtaccgtattggtgtataggtctttgcgga

SEQ ID NO: 4600 - DNA, 79 bp, Homo sapiens
gttttatgcttattttattattactgcagtagttgactttgctgtatggaaaaataaagtgaaattgccctaataaaac

SEQ ID NO: 4601 - DNA, 85 bp, Homo sapiens
gcacttgatactaaccgagctgtctatatcctagccttgtgtcaaaggcttgtgatgtgttgtgatagctgggtttaagaagtgc

SEQ ID NO: 4602 - DNA, 65 bp, Homo sapiens
gtttataatagatttattaagttgttttgccaaagaaggagagaacagcatatgtttatttgaat

SEQ ID NO: 4603 - DNA, 87 bp, Homo sapiens
gagccaatggcatctatgaggcaatctaccatgggatccctatattgggcattccattgtttgccgatcaacctgataatattgctc

SEQ ID NO: 4604 - DNA, 79 bp, Homo sapiens
ttcttggctcacttcctcactctctcactttctggaaggatgttcagagggaaaagagatgggtgcaataaaccaagaa

SEQ ID NO: 4605 - DNA, 70 bp, Homo sapiens
attgtgacctgggttcaaaagtgctaaaaagttctcttgggctctttgggatctggaattgggttacaat

SEQ ID NO: 4606 - DNA, 86 bp, Homo sapiens
tttaaaatgtattggtttttctaaaagtattcaatatctaagttcaaatagataatattttaatgagaaaataccaatattgtaaa

SEQ ID NO: 4607 - DNA, 88 bp, Homo sapiens
gggaaggggagccttctggaggatagagcagggtggggtaagagctgtttacccacaccccagctccccttagctcatctcccctccc

SEQ ID NO: 4608 - DNA, 90 bp, Homo sapiens
ttctgctattctgccttaaaaattaaaacgtttacctattattagcttctggttaatagctagttaagcagatgtgtgggcggaacagaa

SEQ ID NO: 4609 - DNA, 72 bp, Homo sapiens
ggcaaatctggggatctttggggattggaaaccttttgtgtcgattcttggagttctaaaaatccagatgcc

SEQ ID NO: 4610 - DNA, 77 bp, Homo sapiens
tagctatgggcaaatcactaatctctcaatttcatctgctctgaaatgaggataatgatatttacctcccaaggcta

SEQ ID NO: 4611 - DNA, 90 bp, Homo sapiens
tcatctaagattataatgcaaatcagtcatcataaaaaatataaagatctagaatttatagaaattctactgagcatttattttatgtga

SEQ ID NO: 4612 - DNA, 60 bp, Homo sapiens
ggaagcacttagaggcttgaggttgccagctgtggggggttgggcctgtgcagtgcctct

SEQ ID NO: 4613 - DNA, 83 bp, Homo sapiens
acagttgtgatgaggcatcttcagtgtaatcgtccaaatcaaatatttggctgtgcttcttcagatgcgatatctcatattgt

SEQ ID NO: 4614 - DNA, 81 bp, Homo sapiens
tatatttcagttatgcaagttcttttctttgccaaaggcaactggagtcctagaaaaggaagattaaattactgggatatg

SEQ ID NO: 4615 - DNA, 78 bp, Homo sapiens
gaaattagctgcttatttggtataataaatggtttttgcaagatgcaaaaatatctaatatgtaggctttctaatttc

SEQ ID NO: 4616 - DNA, 80 bp, Homo sapiens
tccctctactcccaggttccctttatatgttaagatataatggctttgaggggggaaaaaataaacctaggggagagggg

SEQ ID NO: 4617 - DNA, 85 bp, Homo sapiens
tatgttagtgtagagtcttgtgagctcagctgtctaggaatgtgttgtcattcagcagtttttcattattgtctctaaacacata

SEQ ID NO: 4618 - DNA, 66 bp, Homo sapiens
gtttgaaaaactgttttattgggttagaatactataattctactgcaaataaaatatcttttaaac

SEQ ID NO: 4619 - DNA, 71 bp, Homo sapiens
ggagggatggcaagagagaggcagacagaagtcaggtgagttccctgctggttcttggccttcttcccttc

SEQ ID NO: 4620 - DNA, 66 bp, Homo sapiens
ttctgagatatgatctgttggattctctactaccaaagtgggggaaaaacaggtggtactccagaa

SEQ ID NO: 4621 - DNA, 84 bp, Homo sapiens
ctggtttgctgtttgctcagtgatgagtcaggaggagctatttcaactggctgtgccatggctgatggggcagatggcagccag

SEQ ID NO: 4622 - DNA, 62 bp, Homo sapiens
gtaacatgatttctactagttaatttcttaagaaagtgattccaagttgaaatgcatgttat

SEQ ID NO: 4623 - DNA, 73 bp, Homo sapiens
gcttgacaacatatttagaattttctgagttttactattaataaagttaaaagaaaatctagtatgttcaggc

SEQ ID NO: 4624 - DNA, 89 bp, Homo sapiens
tcttccagttgtccacaacctcacaaggccagagaagcgagagatttctattctggaaaggagtgagtggatggcacaactggtttgga

SEQ ID NO: 4625 - DNA, 77 bp, Homo sapiens
ccaagtggaggtgactggtggtaaatacaatgtggaaggcaatcttggtcagccacgtgcctttacctgctatttgg

SEQ ID NO: 4626 - DNA, 84 bp, Homo sapiens
gtcaaggacagtctgacttcttagttctgccagcagttttttaaagctgcttcctgtactagggaacgttcactgttcttgcac

SEQ ID NO: 4627 - DNA, 87 bp, Homo sapiens
cctcctgctcttcttacacagctgtgtgcttcattaaatagtgatgtctacaaatcacagcagtgttaaaaaatgcagagcaggggg

SEQ ID NO: 4628 - DNA, 73 bp, Homo sapiens
caaagttcagggaggccggggtgagggggagctgactcccactgcccctttgttttcctcctcttgttctttg

SEQ ID NO: 4629 - DNA, 74 bp, Homo sapiens
ttgtggtgtcagacattctgctctaattgagttaattaaaagttaatggcacagagcacatcgtgacgctataa

SEQ ID NO: 4630 - DNA, 61 bp, Homo sapiens
agcaccgaatgattgttcgttgcaggaaacaagaccttcctctggtaaaggctgcggtgca

SEQ ID NO: 4631 - DNA, 80 bp, Homo sapiens
ttaatattcacaattacagtggctacaactcggaaacggcatcaccaatgctgcccagagtcactttatattgaaattaa

SEQ ID NO: 4632 - DNA, 90 bp, Homo sapiens
gctacttcctacacatacctgttctgatatagccaaaaccatttggtgacattatcaactaattaaggtgagaaatgtgatagaaagagc

SEQ ID NO: 4633 - DNA, 87 bp, Homo sapiens
tatcaagagtactgtttaggaaatatgttatctatggcaaaatagttcttaattataatgtagtgtttttggacagtataaatgata

SEQ ID NO: 4634 - DNA, 89 bp, Homo sapiens
tcattgtgacttttgttcttagggaagcagagaagactccccaagttcttataacctcattgtgcttccctaatttaaagccatgttga

SEQ ID NO: 4635 - DNA, 77 bp, Homo sapiens
gaagaatcatttccaagctttctcaccaattcattatttggtaacagtgggattttggaaaatgtcactctttcttc

SEQ ID NO: 4636 - DNA, 78 bp, Homo sapiens
gccccggtctcaggcggccttttctgtgccgttgttgttttcatggagcaggttggagagcttccctgaccctggggc

SEQ ID NO: 4637 - DNA, 69 bp, Homo sapiens
tctgcagaaaattaaatcgaacgagagacctccagccgggagatttatccgatttaatgttttgaaaga

SEQ ID NO: 4638 - DNA, 76 bp, Homo sapiens
cattcatcatttatttgctgctgcttttcattttttaagaggtgaaggaaatgcaaattagcaaatgaatgtcatg

SEQ ID NO: 4639 - DNA, 88 bp, Homo sapiens
gctctaagctgtgtcaagaacagccacgagacaggaaggaggttgtcctccattccccctccatttgacacagggctacacatagagc

SEQ ID NO: 4640 - DNA, 68 bp, Homo sapiens
ctcttaatcctgtccttttaactctgtggctagcagacttaagagtgaagtgagacaggaatgatgag

SEQ ID NO: 4641 - DNA, 80 bp, Homo sapiens
aattccattagcttatataaggggctttgcatttttggctaaggcataaaaagtgtattttctcgttgaatactggaatt

SEQ ID NO: 4642 - DNA, 90 bp, Homo sapiens
acgaaactgaactgaaagctttagctgaacaatggacacaataaacattttatacactctataaagcaaaagcttaatacccagttgtgt

SEQ ID NO: 4643 - DNA, 64 bp, Homo sapiens
cctgggcggttttcgcctacagacgctaccactgtgggagtgtgtgtgggcggaacggccccgg

SEQ ID NO: 4644 - DNA, 86 bp, Homo sapiens
gggaatgagttagtggtaaatagttaatcaaacaatagattttaataatttattgtttcacatcatgtgcgttgttagcttttctt

SEQ ID NO: 4645 - DNA, 68 bp, Homo sapiens
aggattccaaggtttcagagaagcaattgaaatttttggatgcttctcttcaaacgctttagaatttt

SEQ ID NO: 4646 - DNA, 82 bp, Homo sapiens
gtcgcctgcaggaagtgttggcgcagcttcgctggcagactgacggcgagcaggcggcgcgcatccgctatctgcaggcggc

SEQ ID NO: 4647 - DNA, 61 bp, Homo sapiens
aggaggtcagtgaggttgggtttcagtattaaataattttaccaatttgtcctgctctgct

SEQ ID NO: 4648 - DNA, 81 bp, Homo sapiens
tgatttctctcttgctacatgtttgtttataaatctgatacctaccaggtgttttaaatgtgtctcatgtgagtaaaatcg

SEQ ID NO: 4649 - DNA, 73 bp, Homo sapiens
gggttgttttggtttggttttttgttcagggtgctaaatagtactgaaaattgataacaaaccaagtcagcct

SEQ ID NO: 4650 - DNA, 83 bp, Homo sapiens
ggagaaggagtagaatacagtttttgaagataaaatctggtcaagtgacaaattttgttgctcaaaatttctagcccttatcc

SEQ ID NO: 4651 - DNA, 79 bp, Homo sapiens
atcacccggtgcacatagtgagaaacagacattctggaaaggatttttgattctcccactaactgtccactggactggt

SEQ ID NO: 4652 - DNA, 66 bp, Homo sapiens
gtgcatgtatgtaataagtatataatatgtgagaatattatatatgactattacttatacatgcac

SEQ ID NO: 4653 - DNA, 74 bp, Homo sapiens
catagcccaaagggggaaccttagatggctcttcaaatggtgaatgctgttttagaaaaaccctttgagatatg

SEQ ID NO: 4654 - DNA, 84 bp, Homo sapiens
gagaaaaatgccagactcattttgaatttgaacttaacaaccagaacccttatttcttcatagcaaaatgatggctactttctt

SEQ ID NO: 4655 - DNA, 66 bp, Homo sapiens
cccaggcaaccggggcggggccggggcgccaggcctggttgcaggcgctgccctcgggggcctggg

SEQ ID NO: 4656 - DNA, 76 bp, Homo sapiens
cggccgggcgagctgcactgaggaatgcgccggggaagaaatctgctccgacacgttctctgtagctgcccggccg

SEQ ID NO: 4657 - DNA, 69 bp, Homo sapiens
gctgaggaagctcttcattggagggctgagctttgaaacaaggtgagagcctgaggggccattttcagc

SEQ ID NO: 4658 - DNA, 69 bp, Homo sapiens
aggcagtggtgcctaagcgcggaggcgcccggcccttgggggtgccccgcgcgcgtagcgccgctccct

SEQ ID NO: 4659 - DNA, 84 bp, Homo sapiens
ttctctaatatatgatctcttgctccaatgctacagctggcttttaatgagttagtaggtacatatggagctagattgagagaa

SEQ ID NO: 4660 - DNA, 67 bp, Homo sapiens
gaatcactccaatgattttaaatcactcttcaatgtgcagagcaatttaaaattactggagtgcttc

SEQ ID NO: 4661 - DNA, 68 bp, Homo sapiens
gaaaaaggaaacacacttcacacatttctgctctagggagacagaagaagagtgtttctgaccttttc

SEQ ID NO: 4662 - DNA, 61 bp, Homo sapiens
gccctgggtgactgacagagggctaacctggttaccaggtgttctctcgtcagcccagagc

SEQ ID NO: 4663 - DNA, 89 bp, Homo sapiens
gtaccacttgaactggacctcggggtcttcgtggctcacgtccaccaccacgcacgtgacctcaggggtccgggaaatcataagggtat

SEQ ID NO: 4664 - DNA, 77 bp, Homo sapiens
agcaataatgtatagttttgtggtcattactggtcagataataaccggcagtgaccttaaaaccatgcattatggct

SEQ ID NO: 4665 - DNA, 86 bp, Homo sapiens
agtaagttacactctttttaaaacacttttttgagtactgatgctgattcttgccttcagtactaaggggcaacttgtaacttact

SEQ ID NO: 4666 - DNA, 72 bp, Homo sapiens
tagtttcagaaattgctctctggccaaggagctatctgcttcacaatggaccatgcaataaatcttagacta

SEQ ID NO: 4667 - DNA, 73 bp, Homo sapiens
gaggctcattaaaaatggcatttatactggaaaccttaggaggatggtatgtaatgaatcattggtgagcttt

SEQ ID NO: 4668 - DNA, 71 bp, Homo sapiens
aatgaccattgtattagcttcacagaaaggactagccagcttcttggtctaaggctaacatggtgatcatt

SEQ ID NO: 4669 - DNA, 68 bp, Homo sapiens
cagtgtgttgacagtttccttcctcttgagtcattgttgtctgctaaatgatctgtgacagcaaattg

SEQ ID NO: 4670 - DNA, 90 bp, Homo sapiens
gcagacaaaggatatattccctgcttgatatgtaggacttcggctgcttagccctcatgaatgttaatgggaatacaaccttctttctgt

SEQ ID NO: 4671 - DNA, 78 bp, Homo sapiens
cagggggctgcaggtctccgagggggcttgcaggtgctgtgccttgatcaagcccaccagcagccgctcagcctcctg

SEQ ID NO: 4672 - DNA, 87 bp, Homo sapiens
tacttttgcagttaacattttttacaatcatgttattttgtggtttatttgcaaaatgcattgtgagccaagtttgcttcaaatgtg

SEQ ID NO: 4673 - DNA, 72 bp, Homo sapiens
attcattttctctgagggacagagtggtttttattaatggagcaacatctgttctttcagaagtaaatgagt

SEQ ID NO: 4674 - DNA, 76 bp, Homo sapiens
ccacaagtcaaaaaatacaaaagttaagatttttataattctatttgggaatctctagctttttctgttggtgtgg

SEQ ID NO: 4675 - DNA, 67 bp, Homo sapiens
ctcggctcttcccccgtccctgcggcactgctgctgcatcataccgactggggggaggacagccgag

SEQ ID NO: 4676 - DNA, 81 bp, Homo sapiens
tccagctcgcctgcctgggagtataggtgagcgagggaaaaaacctaattaagctagtttatacattttaacaggtctgga

SEQ ID NO: 4677 - DNA, 70 bp, Homo sapiens
atggagcctttaaaaatgtaccagttcgcatagtgttttcattatataagtggttatttctaggttgcat

SEQ ID NO: 4678 - DNA, 73 bp, Homo sapiens
gaaggagcaaatgggaagtgtagtctgttaaacaccatatgtgatggagctgcaccagtctcatttccccttc

SEQ ID NO: 4679 - DNA, 74 bp, Homo sapiens
acttgtcaggactggctaacgcggattcgactctccatcatgagggtaggattgttggcaggccagcctgcagt

SEQ ID NO: 4680 - DNA, 79 bp, Homo sapiens
cagaagcaaatttggaagcagaatatttccatgggaaactgaattatttttccctggagctgcatttcaccaatttctg

SEQ ID NO: 4681 - DNA, 81 bp, Homo sapiens
aaaggaatggtgggctgttatctgtcctccacacttgtcgccctggcacgtgtggttggctttaattattgatatttcttt

SEQ ID NO: 4682 - DNA, 85 bp, Homo sapiens
aaggatttattgtttaaaagactttccctctggggataatttgctaataaatagtccatcataggtgaaagtttcttggaccctt

SEQ ID NO: 4683 - DNA, 63 bp, Homo sapiens
attttaatgagagagacactggggaagtgtgagtggcttcctctgttttctttgatctaaaat

SEQ ID NO: 4684 - DNA, 77 bp, Homo sapiens
ttcctgatgggtcataatgtttaatgagatgcatgggaacctctgaattggatgaatattcaagtgatcttcaggga

SEQ ID NO: 4685 - DNA, 78 bp, Homo sapiens
cagcatattgtaaagtgtgtttttctggtgataatatttttgtcaaagtgatgcagattttaaaatactctcttgctg

SEQ ID NO: 4686 - DNA, 75 bp, Homo sapiens
agacacaatggaaggcaggctggcttatatatgttattgaatggactgtttaaacagcactatccattgtagttt

SEQ ID NO: 4687 - DNA, 84 bp, Homo sapiens
agcaacaggccaggctggcaggaggtccagcctcacactcagagctatgttggcctgggtacgacctctgctagctatgttgct

SEQ ID NO: 4688 - DNA, 79 bp, Homo sapiens
caggggagatcaaagcatttagtcattcttgtccactgaatgcagaggtgtgagtgtgaaattttgcatgattcctgtg

SEQ ID NO: 4689 - DNA, 86 bp, Homo sapiens
aatgtatattattgtgacttttaatattcttccttctgaagagagaaaaatgtaaatcaggagaggaacagttacaatgcaacatt

SEQ ID NO: 4690 - DNA, 87 bp, Homo sapiens
atttcgatgaacacattcccactgggtttctactgattgtgaattaattttactcaggtatttctcaaggggaatgtttcatgaaat

SEQ ID NO: 4691 - DNA, 69 bp, Homo sapiens
ctgaggagacagactgcaggtgttagtaaatgtttccaacacttatgtcaatacctgtatttggctcag

SEQ ID NO: 4692 - DNA, 65 bp, Homo sapiens
tcttatgtttctgtaaataaaattgatagcatgttattagtgtctttgtttccagaattctgaga

SEQ ID NO: 4693 - DNA, 78 bp, Homo sapiens
agagttgtattgtgtggaagggaggaggaaagatgccgggctgcacagccctctgttcccttcatcgcaaaataacct

SEQ ID NO: 4694 - DNA, 69 bp, Homo sapiens
tgtgccagatgtatacacagctgtacggctaccgctgtggacccagctgctgactgtacacctcccaca

SEQ ID NO: 4695 - DNA, 72 bp, Homo sapiens
cttccatctcactggagaagatggggataggtcctctgagaccttaatgactatcatctactcagatgggag

SEQ ID NO: 4696 - DNA, 80 bp, Homo sapiens
acatgaccctatctatgtatttatagagcgcctatcactgtaggccccatctttctagggacgtggacttggggccatgt

SEQ ID NO: 4697 - DNA, 80 bp, Homo sapiens
gtccccaaagggatatttcagcacagagtttcaatgtaaaatgacacacgctactgcaggctagagatcttattggggac

SEQ ID NO: 4698 - DNA, 76 bp, Homo sapiens
gtttgagaaaaggtgaagaattttggcaatggacaagacatccagcacaaaaggggcctcacctgctttgtcaaat

SEQ ID NO: 4699 - DNA, 88 bp, Homo sapiens
cctggataattctatttgagtgagttttaacttgttgtgatagtactatctgaacaggtaggaaaattcacaccaaataccacttagg

SEQ ID NO: 4700 - DNA, 64 bp, Homo sapiens
ccccaggctcccttggcattcctttcatagagctgaagccagggaggtgagggcgggtctgggg

SEQ ID NO: 4701 - DNA, 84 bp, Homo sapiens
ggaacaaagccagagggttctcctggcaactgcctgacatgctaaatggcaggccccggcactgagggaatcctctgctgaccc

SEQ ID NO: 4702 - DNA, 87 bp, Homo sapiens
gctctgcggctgcgaaaacccggagaggcggattggagcgcgctcaccgcgctctcagccaactcctccgcggtccggccgccgagc

SEQ ID NO: 4703 - DNA, 87 bp, Homo sapiens
actctatttgttaatagggtagatttaagtcgatgttctctaacacagtaaacataagcttaaatgttccctaattagagatagtgt

SEQ ID NO: 4704 - DNA, 69 bp, Homo sapiens
ctcagggcagcaaagagaacatagagattcacaaatgagctttctttgtagggcactgtctgctttgag

SEQ ID NO: 4705 - DNA, 88 bp, Homo sapiens
gctcatctcaatagactaattttctttcacacataggatgatggataaacatatctgcctgtggtggaggaagtttcttgagatgagt

SEQ ID NO: 4706 - DNA, 78 bp, Homo sapiens
acttataccccactcatctcctgaagtccccagttagttctggaggagatggatgatgtcttaaagaggtttatgagt

SEQ ID NO: 4707 - DNA, 89 bp, Homo sapiens
ccaaattctcatcttgttccaccccctgctgagctcctattgacttcaaagagaggtccatgggggtcctgagcaagatgagaatttgg

SEQ ID NO: 4708 - DNA, 83 bp, Homo sapiens
tgaggcagcacagaaggcagcccttcattaaatccgacaccagggaattaattcaactcactgctgtcactctgtctccctca

SEQ ID NO: 4709 - DNA, 76 bp, Homo sapiens; identical to SEQ ID NO: 4359

SEQ ID NO: 4710 - DNA, 87 bp, Homo sapiens
gagtgagctggttttctgtgtggatcctggtattttcctttgagttggggaggagaatggtggggcagggagggaaggccggccgcc

SEQ ID NO: 4711 - DNA, 79 bp, Homo sapiens
agccatgccagacccctactctgctggccttggctctggttcccagggtgattccccagctgggctcaaggccatggct

SEQ ID NO: 4712 - DNA, 82 bp, Homo sapiens
tggtatgttttaaactggtatttaaaagctatttatctcttagtggggacaaatattcttttaagtcattaattggcaacca

SEQ ID NO: 4713 - DNA, 88 bp, Homo sapiens
gccctggcccctgtggggaacaggtcttggggtcatgaagggctggaaacaagtgaccccagggcctgtctcccttcttgggtagggc

SEQ ID NO: 4714 - DNA, 68 bp, Homo sapiens
tatctataaaaatttgtttctagatggcaattcaaaatttaattttcatctcagatttttaaaagata

SEQ ID NO: 4715 - DNA, 75 bp, Homo sapiens
aaatatttatgtaagctccgtgggttgaaaaggtagtttaaggagattgttttaaccacagctttgtaaatgttt

SEQ ID NO: 4716 - DNA, 84 bp, Homo sapiens
agcctaagcggagagcgaggctgtgacctctcgttccctggaagaagacggccaagggtcctgtcctcgttctctgcctctgct

SEQ ID NO: 4717 - DNA, 84 bp, Homo sapiens
gcctctcgtcttgagtggacatgactgtattccattaatatctccaggaacagattagaaaagtccgtcttactgatggaaggt

SEQ ID NO: 4718 - DNA, 84 bp, Homo sapiens
gggggcaggggaaggtgacggaaacggctagttacccagaattctctgggggaaccagaaaaatcggttatctagaattctccc

SEQ ID NO: 4719 - DNA, 79 bp, Homo sapiens
ctgtcagttgcaatcaaggctgcccagtattctgaaacaatctcattttgctaggtggctagtcttgtgcagcttctag

SEQ ID NO: 4720 - DNA, 87 bp, Homo sapiens
agaaagtattgatcacaattagatcatatattagcagccctgatgctgggactgctaaggatttcaacctagatcattctgccctct

SEQ ID NO: 4721 - DNA, 73 bp, Homo sapiens
gacaggcagggcgggaggtggacgggcggctggcagcaggcggccagctgccacagccgtgccaggctctgtc

SEQ ID NO: 4722 - DNA, 76 bp, Homo sapiens
tttctcaaatgaaatcctgcccagaacatcagcctataaagcagactcttggcagaatagacatcatttgtagaaa

SEQ ID NO: 4723 - DNA, 76 bp, Homo sapiens
tttcttctctgcttagaggtgtgtaaacagtggggtccctcgggtcttatttacataattgatctaaaagaaggaa

SEQ ID NO: 4724 - DNA, 77 bp, Homo sapiens
gccggctccaacccagaggcccggaataggcgcggagttataaatagtgccacccgcaggtgttggggggagtcggc

SEQ ID NO: 4725 - DNA, 85 bp, Homo sapiens
gttgacagcaagtatgacttttatgggtgctaccagaatatgatctattcacttgtagcagctagaaaagattttgtaattcaac

SEQ ID NO: 4726 - DNA, 68 bp, Homo sapiens
tccagcatcttttattgcattggaaagactggcaaagtcttttggatgggttgggagatgtggctgga

SEQ ID NO: 4727 - DNA, 74 bp, Homo sapiens
tccatggcaacagtgtaagtgtcagcaaagaagtgtttctgctcttctctgcctcctcttaactgtttcttgga

SEQ ID NO: 4728 - DNA, 66 bp, Homo sapiens
gcatcgagtatcctagaattcacttaagtcttgccaagaaattaaggagcttcaggaacttggtgt

SEQ ID NO: 4729 - DNA, 85 bp, Homo sapiens
gaaacctgtgctgacaagagcgctccttagcagccaagggctgtagagcccgcaccacgtgctagggagcgcccagcgctgtttt

SEQ ID NO: 4730 - DNA, 89 bp, Homo sapiens
ccaactgattagggtcattatgttggaggtctgatttatgttgtcatttcctctcaccgatcctgcatcaatgaatcttaatgaattgg

SEQ ID NO: 4731 - DNA, 61 bp, Homo sapiens
ccccagcctggctccctgcggcattcccatgggagtgcaggggcagggggccagggtgggg

SEQ ID NO: 4732 - DNA, 80 bp, Homo sapiens
gctgggccttgactctcacttcctgccccactcctggctcagccagtttgggcagtgcctagggagcccagagacccagt

SEQ ID NO: 4733 - DNA, 68 bp, Homo sapiens
gcctgagtgagctagtagtattttggcaggaccaggaaaacttggttctgaatgaggtatacttaggc

SEQ ID NO: 4734 - DNA, 70 bp, Homo sapiens
ttcagacctgtctggttcaaaaccttaagtaaggctgtcatcagtgtggtttaacgcaggcaggttagga

SEQ ID NO: 4735 - DNA, 84 bp, Homo sapiens
tccttccacctcttagttgtaagcctactaaggagtaagtttatcctacttccttttgttgtgtttatttttaattggggagga

SEQ ID NO: 4736 - DNA, 83 bp, Homo sapiens
ctggcaggtggcctggtctgctagctggcttctgagaaatgatacacatggaggcctcacagacagatcaccactatctccag

SEQ ID NO: 4737 - DNA, 68 bp, Homo sapiens
gtgctgtgaggtctgcgggcgctggcaaatccggcccaggatgtagagctggcagtgcctgacggcgc

SEQ ID NO: 4738 - DNA, 67 bp, Homo sapiens
gcatgatttttattagccttgcaatttcttaatgggctcccctgagggctggctggtagaatcctgc

SEQ ID NO: 4739 - DNA, 82 bp, Homo sapiens
gcacttggctttgaaatgaaaattgggtgactaaagacaaagatttttgggcagcaatttttagaacatagaggtaagatgt

SEQ ID NO: 4740 - DNA, 72 bp, Homo sapiens
gcagtgctttgctggaatcaacgaatgtgcttaattcgaaggtgtctttgtcggttacagcaatgctgctgc

SEQ ID NO: 4741 - DNA, 69 bp, Homo sapiens
tctggtaggacagctcgaacatggtgcaagcctcctctagactctcgtccatgttcagtctctgccaga

SEQ ID NO: 4742 - DNA, 76 bp, Homo sapiens
aagatttattggttcaagagttattgatcatgggcaaatcttggccattattatgccttgaggacaaataaatctt

SEQ ID NO: 4743 - DNA, 75 bp, Homo sapiens
catttcttttatgctttttagaaaatagctttttaaaacagtgacaagctgttatgagaaagaaagagggaaatg

SEQ ID NO: 4744 - DNA, 87 bp, Homo sapiens
aacacatcactgagaccatgttaaaggcaggttaacacagtaaaagaatctgacctgctttggagtttaacagtctttgtctgtgtt

SEQ ID NO: 4745 - DNA, 67 bp, Homo sapiens
aacttgaataatgggcgtaaatagtgacagaatccttttttacttccgtgttccacttattcaggtt

SEQ ID NO: 4746 - DNA, 73 bp, Homo sapiens
ggccccagaaagggaccttgtccaccctgatatgtaaggatgtgaaggagtgaggagtctttctttgggggcc

SEQ ID NO: 4747 - DNA, 89 bp, Homo sapiens
gtggtagccagtgtttcaaatgccagcggaaatgcaatctctgctagaaggaagcacttatgaactggcaaagaataaatggctgccat

SEQ ID NO: 4748 - DNA, 83 bp, Homo sapiens
aacagatgaatccactgaaatgtaaaatattctgcaaagttttggcagctttgaaatgctacactttctagctctcatctgtt

SEQ ID NO: 4749 - DNA, 85 bp, Homo sapiens
cgtgctctttggttttgtctgggttgcagtttaattcagcaggaagcgggctgtggctgggaaccacagcacaaagaaaatcacg

SEQ ID NO: 4750 - DNA, 82 bp, Homo sapiens
cagatatccagccaggaagtgcaagggaagaggaggagctgtttccacttaccctcctacctccttttggctttctcttctg

SEQ ID NO: 4751 - DNA, 88 bp, Homo sapiens
tgcatgttggtccatgttaattaggcatttgtcctttagtctggaggtgatagaaaatgccagttactgtggtatttaactgacatca

SEQ ID NO: 4752 - DNA, 76 bp, Homo sapiens
ttatggcttttatttgggaatttgtcaaggtttcacatttgtagaagccttgaagcagtggcctaatagtccataa

SEQ ID NO: 4753 - DNA, 87 bp, Homo sapiens
agctagcatggctatttttgcctctgcctcatcattcagtgcaaaagggcagaggtgagtgcctataaattcacacagctgctggct

SEQ ID NO: 4754 - DNA, 68 bp, Homo sapiens
tagacagttgagggaattaggaagataaattttatttgttttcttcctagcatgaccagaattgtctg

SEQ ID NO: 4755 - DNA, 79 bp, Homo sapiens
tagtgtcattgatgcaaataatagtttaacttttagtttagaactcctaaaagatataaattgtattgcatatgcatta

SEQ ID NO: 4756 - DNA, 77 bp, Homo sapiens
gaattgcttaatgtttttggaagtaataaaactgcatttctttttaattaaacaatccagataacaagaagtaattc

SEQ ID NO: 4757 - DNA, 85 bp, Homo sapiens
aattagctggcttgtgaaatagtgcagtgttggatgcttcaagaggtataatcctattttattagcacaaacttgctagctaatt

SEQ ID NO: 4758 - DNA, 75 bp, Homo sapiens
tgatgagagcctattgtgaataacaggatttgtcaatgaggcagatcagattcggatttgatgggcagtcaatca

SEQ ID NO: 4759 - DNA, 77 bp, Homo sapiens
taattcttcttaattatgttagtgctgggccatcaatcaagtttattgatgctgtctggtcatgtctagaagattta

SEQ ID NO: 4760 - DNA, 78 bp, Homo sapiens
tctttaggtaatctaaatttagtttgagacatcccagttgtgtatctcaaatttagaaaaatttagagttcctaagga

SEQ ID NO: 4761 - DNA, 85 bp, Homo sapiens
gctgctttgggggttttccgcccttccgcgcggctgcagctccccacggcagccccgcaaccaggcggataaccctttcctcggc

SEQ ID NO: 4762 - DNA, 74 bp, Homo sapiens
gcttctctccgcacacacgtcacccgcagctcacgtcaccgaggtgcgggggatgatgtcacgcggccggaagt

SEQ ID NO: 4763 - DNA, 82 bp, Homo sapiens
acagttgcagtcataaaaatgtaattgctgagaaattatttctgatccattggaagaatttattacagagggatgcaactgt

SEQ ID NO: 4764 - DNA, 78 bp, Homo sapiens
cagggtcaatcagctaaataaactagtcattcagtcaactagcattgattagattttagcaagatggaattgactttg

SEQ ID NO: 4765 - DNA, 85 bp, Homo sapiens
gaagggcttgagtcactgttgatgaacaattgcatcatttcaaagtaaatgagtatgaatcatcaatatgtaaacacagtcattc

SEQ ID NO: 4766 - DNA, 78 bp, Homo sapiens
aaaaatagctttgtaagagaaaaacgatgtgaaatttatgttttaggtcaatatgttggggatttctgagctgttttt

SEQ ID NO: 4767 - DNA, 65 bp, Homo sapiens
tcttggcttttgctcaaaatttgaaagcaaatgggaatcagtttcaaatattggaaaagtcaaga

SEQ ID NO: 4768 - DNA, 77 bp, Homo sapiens; identical to SEQ ID NO: 4282

SEQ ID NO: 4769 - DNA, 77 bp, Homo sapiens
gctacactatggtcgtgggcctcaacaagggccacaagttgaccaagaatttgagcaagcccagacacagtcgtagc

SEQ ID NO: 4770 - DNA, 84 bp, Homo sapiens
gcagagtcaacctgctcttatttttgctcattataaaacaggagttataatattgcaaagtttattagctctgttgatttgtgt

SEQ ID NO: 4771 - DNA, 89 bp, Homo sapiens
tgtgcacagcatcctgcgggtggtgctgggtgcaaatggcacctacagctgcctggtgcgcaaccccgtgctgcagcaggatgcgcaca

SEQ ID NO: 4772 - DNA, 72 bp, Homo sapiens
ggctggatggagagtttgctatgctggagacatgctttgatgtctgcagggaaggttgtgtttcattcagcc

SEQ ID NO: 4773 - DNA, 83 bp, Homo sapiens
ctgacagtgtaaagaaaaaagtgagagaaaattaccattgtactttaaatttctctgattgaattgactgattatactgtcag

SEQ ID NO: 4774 - DNA, 73 bp, Homo sapiens
ctgggtttggtataatttaatttaaaattctcatttatagagtattttatttaatctagtataaaaaatctag

SEQ ID NO: 4775 - DNA, 78 bp, Homo sapiens
gttgacattttttgctgccctggagtttattgtctcaagtattgcttgaaataccagggtacatgcagagatgtctgc

SEQ ID NO: 4776 - DNA, 85 bp, Homo sapiens
tctgtacgcagcctcctgctgggttaagtgtgagctaagttattattttgcttacatctgcacccttgtaggctgtgaaagcaga

SEQ ID NO: 4777 - DNA, 68 bp, Homo sapiens
attggtgcagatgctccacctgtattaatgtttgtttttgtacacattagtagcaggagtacaccaat

SEQ ID NO: 4778 - DNA, 66 bp, Homo sapiens
tattggttttatttttagcttgtgtcagtcagccacgctgactgagggctgacactaaagccagta

SEQ ID NO: 4779 - DNA, 83 bp, Homo sapiens
cagtaaaatgcattccctctatgctcattgtaatttactttatagtgacttgcttaatagcatagcatatatcatttatactg

SEQ ID NO: 4780 - DNA, 75 bp, Homo sapiens
atgccaatgaccctcatgccgtatttactagcatgctattttgagcagtgcctgtgcatcagggtaatttggcat

SEQ ID NO: 4781 - DNA, 83 bp, Homo sapiens
cagatgtacatcatgaattgtttcctagccatggagtcttgcacattcatggtcatggcctatgatcgttatgtagccatctg

SEQ ID NO: 4782 - DNA, 83 bp, Homo sapiens
gccaggcgggccaggccctcacgcagctcactcagctcaaacaggctgacgtccagcagctgcgctgcccggcccacctcagc

SEQ ID NO: 4783 - DNA, 82 bp, Homo sapiens
aggccaagtggaggagcctgatccaaggcctagctcctacccaggccctggcaggccagttggctcctctctccacctgcct

SEQ ID NO: 4784 - DNA, 82 bp, Homo sapiens
gttggctttccaagtgtcaatgcctgccagctcctggtacattatttcctcagcagctggcacgggattttttgttgccaac

SEQ ID NO: 4785 - DNA, 76 bp, Homo sapiens
cctaagtgaatactgttttacataggattctgccagttagttctaactgcgaaggcaattatgtggaatgcttagg

SEQ ID NO: 4786 - DNA, 77 bp, Homo sapiens
ggtgatttcctggagccaagcctaggccccccacactggtggggtgagggtctggagcttggctaagggattgcacc

SEQ ID NO: 4787 - DNA, 79 bp, Homo sapiens
attaaaaatgaaaactagaccacacaggagaaataaaagaaacaatgtttctatctttcatggtaaattttcatgtaat

SEQ ID NO: 4788 - DNA, 82 bp, Homo sapiens
ctgctgcccgctggagccctagtggctccctcgcttggcaacaacacaagtctcatggccgcagcagctgcagctgcagcag

SEQ ID NO: 4789 - DNA, 76 bp, Homo sapiens
gtgcaatcatattgttagtttccccaaagatacatatgtttgtgatttggggcaagagaaaagccatacattgcat

SEQ ID NO: 4790 - DNA, 69 bp, Homo sapiens
tcctcttgtaaaacacgcttttctctcttggctgctcagtggagaagtgtttttcttcagcaagagtga

SEQ ID NO: 4791 - DNA, 85 bp, Homo sapiens
gcccctaggcatggagtatgaggcaccatccttttgaagatgctgatcctcagaacctccttgtacttcatctacccccaggggc

SEQ ID NO: 4792 - DNA, 72 bp, Homo sapiens
ttgtcaatcaaatatcttgttatacacaggtctgacatcaaatttaagtataataagatataagattgacaa

SEQ ID NO: 4793 - DNA, 71 bp, Homo sapiens
agcctgcccaagacaggtttttcccttgtaccatcttcagagaggtcaggggaagagggtccaggtgggtt

SEQ ID NO: 4794 - DNA, 70 bp, Homo sapiens
ctgctgtctgttctgttcagccttcagctaaacagcaaatgaagtgtccacatgacagactattcagcag

SEQ ID NO: 4795 - DNA, 62 bp, Homo sapiens
aacgggggacactggttgccatagtgactatgagagacctgtgcagtcacatgtctactgtt

SEQ ID NO: 4796 - DNA, 77 bp, Homo sapiens
ttttcctgttacttcatttgttgttcaccacttcaaaatcagcatggggtggtgggaaaaacattaggagaggaaaa

SEQ ID NO: 4797 - DNA, 60 bp, Homo sapiens
aaaggcaggataatgtttatttaataagaataatcacctatcgagtttttctttggtcct

SEQ ID NO: 4798 - DNA, 86 bp, Homo sapiens
gaacctgggttttaggattttaggttgccatggagaaaatatgccatgtctccatggaaaccaacctatttgcttaactgaggttc

SEQ ID NO: 4799 - DNA, 78 bp, Homo sapiens
tccttgccctttttactgtgtcactttgtggggttggtgcttgccacacttctgacacaagtccagcgggttttagga

SEQ ID NO: 4800 - DNA, 82 bp, Homo sapiens
aaactggaggcattgtgtgaattagaaattgtgccacggagcccactcaggtgccactaatttatttaatgtgatttggttt

SEQ ID NO: 4801 - DNA, 74 bp, Homo sapiens
atgctattttgaagtatttatgaaatgctagtttgtcaaaaaagtaatcataaatactgctttagaaaaagtat

SEQ ID NO: 4802 - DNA, 68 bp, Homo sapiens
gatggtgtggggagcttgggtgtttgtttcccatttcacaaaacaaagcagccaaccttacattcatc

SEQ ID NO: 4803 - DNA, 60 bp, Homo sapiens
agcaggaaaaaaaaattgattagaagattgtctttcacattccattattgatgtccgggc

SEQ ID NO: 4804 - DNA, 78 bp, Homo sapiens
gtcttgcttctttatggtccatgatgccagctgagactgtcagtacaatgaaatcaaactggccagatggaagcagat

SEQ ID NO: 4805 - DNA, 75 bp, Homo sapiens
accaaagggcaagatatctacttatgccttctttgtgcagatgcgcagagaacctaagaagaaaaacccagtggt

SEQ ID NO: 4806 - DNA, 81 bp, Homo sapiens
tgtctgtctcccagttttcaagggtttagctgtgaaaagtgcggatggtatcacatactcttataaaccatggagcagaca

SEQ ID NO: 4807 - DNA, 84 bp, Homo sapiens
tcccttttaccttgtaaaatcacatttattcatcacctcattaaattgaagaaaatgaacaaaatataaacaaggtagatggga

SEQ ID NO: 4808 - DNA, 71 bp, Homo sapiens
cttctttcctttttagcattgtgttagtgccgggaggccactgtgtcagcaagctgagagggaaactgaag

SEQ ID NO: 4809 - DNA, 67 bp, Homo sapiens
ggaccaagctgctgacagtgctggtagctgaaggcttcagcagctgccctccctgcttctccatctc

SEQ ID NO: 4810 - DNA, 78 bp, Homo sapiens
gcttacctttggcaggaacccagggcaggttcaggaaacggttccgtgttcctgcccttagctttgtgtcaatgaagc

SEQ ID NO: 4811 - DNA, 75 bp, Homo sapiens; identical to SEQ ID NO: 4262

SEQ ID NO: 4812 - DNA, 76 bp, Homo sapiens
cagtgaaattctcctgcagttaaatgaggctcaattatacactactaatttaagcctgcatactgcattccaactg

SEQ ID NO: 4813 - DNA, 69 bp, Homo sapiens
gtggacactttttgtttaattgtcctttgaataacattccaatggcaattgaatagtgcagctgtttgt

SEQ ID NO: 4814 - DNA, 69 bp, Homo sapiens
ggagattgttgtcatggtgtttctatgctaatcagaagcaggaagtactagaaatcttgaagagtctcc

SEQ ID NO: 4815 - DNA, 77 bp, Homo sapiens
gcgcgcgccccgcctccccagcccttccccagcgcccgcgctggggggctgcggccgggaagcggggtcccgcgtgc

SEQ ID NO: 4816 - DNA, 73 bp, Homo sapiens
ctgcattctgtggatcagtttgaacagcttctccaccttatttggacagtgataaattgaaccaagagtgtag

SEQ ID NO: 4817 - DNA, 83 bp, Homo sapiens
attggctctcttcttcaaaggaccaggtcctgttcctctttctccccgactccaccccagctccctgtgaagagagagttaat

SEQ ID NO: 4818 - DNA, 71 bp, Homo sapiens
gggccaacgttttgggcttgggagcctggcccacagcatccccttgggccaggcagacccctcgctggccc

SEQ ID NO: 4819 - DNA, 84 bp, Homo sapiens
tttgcagaagcagtggaaccaaagaggtggctcagcaggaagaagagagggccagatctgtggtggcaagggctgagcagcaga

SEQ ID NO: 4820 - DNA, 60 bp, Homo sapiens
ggctggagcctctgattgggtttcggagtccggtactggagccaatcagcgcgggcagcg

SEQ ID NO: 4821 - DNA, 85 bp, Homo sapiens
aggcagtaaggagggggaagaaggaagaggcagccatcttggagtcgttttgccttttagcctcattctttcgcctcctaagcct

SEQ ID NO: 4822 - DNA, 84 bp, Homo sapiens
aggtatttttcccttctgacagataaatgggtaatctactacaattatattattttcttgttgagaggtaaggaaagtatactt

SEQ ID NO: 4823 - DNA, 81 bp, Homo sapiens
taaacccttggctgtagggagctgaggagaggcattaagaagccatgcctcataaactttaaattcttgcgcaggggttta

SEQ ID NO: 4824 - DNA, 62 bp, Homo sapiens
gtccacaaaggtatcattcaggagctggcagggttagtaacagagttgtatttttggtggac

SEQ ID NO: 4825 - DNA, 86 bp, Homo sapiens
tctctttttcttgtttcattttgcggctcccagttggaaggaaaagttcatcccatggcttatttgaaaaggagcaagtgaagaga

SEQ ID NO: 4826 - DNA, 77 bp, Homo sapiens
agaaggggtcctcaggtgtgctgaaggcattggtgatctgtgagcacagggagctgatgctctctgcctccccttct

SEQ ID NO: 4827 - DNA, 79 bp, Homo sapiens
tcaaaggcggaagagtgggtgtcactgttgaagttggaggagactaccaagtgctcagtgtagcccaggatgcccttga

SEQ ID NO: 4828 - DNA, 62 bp, Homo sapiens
aggcggaggctgtgggtggctgggcagcctgcctgcccgcacccgcccactcgcctctgacc

SEQ ID NO: 4829 - DNA, 86 bp, Homo sapiens
tgcagggactttcatttcctgtattccagtctggaatctttgagacccctaatttcaagttggaaggggataaaattggccctgca

SEQ ID NO: 4830 - DNA, 81 bp, Homo sapiens
ttgtgaatagcatattgatggagatgcactcatggtctgtgggaagtgagaggtgtttctttaaataagctgttagcacag

SEQ ID NO: 4831 - DNA, 83 bp, Homo sapiens
ggtcttggcatcttctacagagacagagagagagtgctttaacaagacttgcgagagttctttgaagaaaagaagttaagact

SEQ ID NO: 4832 - DNA, 75 bp, Homo sapiens
caaggtacttgaggctctatcagggaaactttgagaatgagacattaccagaagctctggagccttaagcacttg

SEQ ID NO: 4833 - DNA, 62 bp, Homo sapiens
catttgtcttaagacctggtgttgtatggatgacaagcagcagccagttatgatgacaggtg

SEQ ID NO: 4834 - DNA, 89 bp, Homo sapiens
cgagatccctccaaaatcaaatggggtgatgctggcactgagtacagtgtggagtccaccagcatcttcaccatcatggagaagtctgg

SEQ ID NO: 4835 - DNA, 74 bp, Homo sapiens
gacagaaccccgacctcagagaagatggatgaggtaccaccgtgtctgtccatctgtctgggactggttttgtc

SEQ ID NO: 4836 - DNA, 86 bp, Homo sapiens
cagtgggtgggggctgggaggggtggagcaggtgcatggggcagcggtgcccagcacctgttccagtcacagctgctggcccactg

SEQ ID NO: 4837 - DNA, 68 bp, Homo sapiens
gttgaagctgtcaggtcctggtggtacaagcactgtttgctccatcttgtcatcctgcacattttaat

SEQ ID NO: 4838 - DNA, 75 bp, Homo sapiens
gggccctgaggaagacggctgaggacatgaacctgttcaagaccaaccacgtgttcttcctcctcctcctggccc

SEQ ID NO: 4839 - DNA, 83 bp, Homo sapiens
tcactcaatggatcccttgtgattggtggacaagtggatgtatttgttaactgctcgcctttgggatctgtgtcattgtgtga

SEQ ID NO: 4840 - DNA, 89 bp, Homo sapiens
cctggtctcagctttgctttttggaggcaaaggaaaaatgatctcctggtttacttttggaatctgcaaagcaactctgaggtcccagg

SEQ ID NO: 4841 - DNA, 82 bp, Homo sapiens
caacttatggaaatgttcttgtcagacattggtgagaagctgtgttttgggggtgctgttaattaagaacatttccctgttg

SEQ ID NO: 4842 - DNA, 72 bp, Homo sapiens
ggggactgaggatgcctcctccttgcctgaagccagtcaagaggcagggagcagaggcaattccttttctcc

SEQ ID NO: 4843 - DNA, 68 bp, Homo sapiens
gtgttatttaactttaaaaacagttgagaattctttttgtattaaacatgaagtaaaataagtagcac

SEQ ID NO: 4844 - DNA, 68 bp, Homo sapiens
ggcctgttgcttgggcatactgtcactgagggaagtgtgcagttttaaaatgtcaaagccagcaggct

SEQ ID NO: 4845 - DNA, 78 bp, Homo sapiens
atgtaaatcctttctgatttatggtttcattagagcagaatcattaattaggccacagaaattcaggagggatttcat

SEQ ID NO: 4846 - DNA, 77 bp, Homo sapiens
gcccctgtctttattacattttccacccttgtcatttgtgattaggccaacactgtgaagatgtattatggattggc

SEQ ID NO: 4847 - DNA, 83 bp, Homo sapiens
atcatgtcatttctaataagatgacacatccttctttgttttttactaataagatgaggtcagttgtattgaagaaacatgat

SEQ ID NO: 4848 - DNA, 69 bp, Homo sapiens
ggagaccgtcgccttctggtgggtggtggggatggacttctcctccgtctaccatgaggggaagtctct

SEQ ID NO: 4849 - DNA, 75 bp, Homo sapiens
ccctatcccattatatgtgatattctagtcttatagatcttatgaagtttaaatattttccagatgggcctaggg

SEQ ID NO: 4850 - DNA, 61 bp, Homo sapiens
aacatatcctctatgttggatcaggacatcctaatggtataaccactattaagggtttgtt

SEQ ID NO: 4851 - DNA, 77 bp, Homo sapiens
gaattctccagggtcttcagctaaaagtgaaacctggaatgattgccagtgaatgctttttgtggccttggaaattc

SEQ ID NO: 4852 - DNA, 86 bp, Homo sapiens
gcgagggtcggggctggggagggagagttggcgagctggctgcacgacacggaaaggcgctctcctttccactttttggccctcgc

SEQ ID NO: 4853 - DNA, 78 bp, Homo sapiens
agagctcaaattttccagtgagcaaatgtagaattttaattagcttcgagtccatttctctgctggaaatagatctct

SEQ ID NO: 4854 - DNA, 73 bp, Homo sapiens
gagtcttttaaagatttagggccagtttacattcctgaggatgtttctgtctttgagtttgaatgagatgctc

SEQ ID NO: 4855 - DNA, 79 bp, Homo sapiens
tgttgcttcaactaaagctatgccaaatgcacattagcaccattagggctactgattggtatcttaaaaggatgcagca

SEQ ID NO: 4856 - DNA, 86 bp, Homo sapiens
gttggagctttcttttattaatgcaaatacaattattagttatgcatttcaatacaccctaaaatggtaaaggacaatgctccagc

SEQ ID NO: 4857 - DNA, 72 bp, Homo sapiens
tcatgtgtctttggatcggtagccacgttcagggacaagcctaacaaggttactgaaggccaagacacctgg

SEQ ID NO: 4858 - DNA, 78 bp, Homo sapiens
gactggaagggtttcacttccgcctggctgcaggaaccacaagttccagactaggtcgtaattggaataatcacagtc

SEQ ID NO: 4859 - DNA, 74 bp, Homo sapiens
gggaagattcttgccaagagaattaatgtgcatattgagcacattaagcactccaagagctgagataacttcct

SEQ ID NO: 4860 - DNA, 88 bp, Homo sapiens
gcctctgggacaatgcaggtcttcatgtcactgatgagttcaaagccaatagggcaagcacagcgaaggccctgaggtctatagaggc

SEQ ID NO: 4861 - DNA, 70 bp, Homo sapiens
tccaccattgattcagacagcagctctagctcctcagggagaaggagcagactgatggcctcagggagga

SEQ ID NO: 4862 - DNA, 82 bp, Homo sapiens
ccccatcgacgtcacggagggggaagtcatctccctggggctgccctttgggaaggtcaccaacctcctgatgctgaagggg

SEQ ID NO: 4863 - DNA, 65 bp, Homo sapiens
ggcaattccagttctgggtgtttcttaagcaaatagagtaaaccatgccagcattaggggttgcc

SEQ ID NO: 4864 - DNA, 75 bp, Homo sapiens
aatgtcttgtaaagtcattcaagtgagaagagtagatacatcaattcttccttggatcctgccacaaggagcatt

SEQ ID NO: 4865 - DNA, 89 bp, Homo sapiens
gccatgtttacctcgggttttatgggtagccttgggaataagggttaattgagctcagaggtgcctgcccattgaggtgaattagtggt

SEQ ID NO: 4866 - DNA, 77 bp, Homo sapiens
tgctgccatgttcttctgggtcatagtcaccaagttcagcctgcagggtgtaggatcccaggagagcatgagtcaca

SEQ ID NO: 4867 - DNA, 75 bp, Homo sapiens
gcagagtggatcgtatgcagaggagactgcaggcaactctctttctgctttgtcaccctttacgacccgctttgc

SEQ ID NO: 4868 - DNA, 81 bp, Homo sapiens
tgttaattctttttctcttaatatttgtttcacatacatgtatttcgaaatcataatgttgattaggaaaagaaacttaca

SEQ ID NO: 4869 - DNA, 70 bp, Homo sapiens
ctcagtgttcatttatccaggtcatttattcgtgagtcatggatttgtggaatgaaaactgaacactgag

SEQ ID NO: 4870 - DNA, 86 bp, Homo sapiens
ttttaaaaaatggtcactttcataaactataaacatctatatcataactctgacctttgtggttcttggaagaagatattttaaga

SEQ ID NO: 4871 - DNA, 71 bp, Homo sapiens
cagataggagcttattaattttcaaaatattcctggacagttaggaaggttatgtggtattatcctgtttg

SEQ ID NO: 4872 - DNA, 66 bp, Homo sapiens
gaccggaaatggtcgtttccatggtaaccctgagcaggttgcctgggagatgacctctttcgggtc

SEQ ID NO: 4873 - DNA, 65 bp, Homo sapiens
gcaagttgggaaatgctgcagtagtctaagatttactgtcagattatttcagggttttgacttgc

SEQ ID NO: 4874 - DNA, 77 bp, Homo sapiens
gggcatctgatccatgagcagtcactctataggctggcaaacagcctatgaaggaacctgggatgagaactttgccc

SEQ ID NO: 4875 - DNA, 71 bp, Homo sapiens
agtgggtaatagccttgttttcccaagagatacagctactttggaatgtcagattaggactgttaccaact

SEQ ID NO: 4876 - DNA, 71 bp, Homo sapiens
gcctaatctgcactgtgtctgggaggctgttgcgaatgtgttgcagctcctggtcggtggtattgttgggt

SEQ ID NO: 4877 - DNA, 60 bp, Homo sapiens
aacggcttggccttctgtgccatcctgcaccgattctacccagacaagatgtgagctgcc

SEQ ID NO: 4878 - DNA, 69 bp, Homo sapiens
aactgtttgaaattagtataccaggcactacctctaaagtgtttgaaaagtttgctcttttaagcagtt

SEQ ID NO: 4879 - DNA, 74 bp, Homo sapiens; identical to SEQ ID NO: 1296

SEQ ID NO: 4880 - DNA, 90 bp, Homo sapiens
gaacatatcatgaagctgagtcagtatggaaaattttcaaataaacagggtgctgaagttccatctgtctcatctgcttatgataagttc

SEQ ID NO: 4881 - DNA, 69 bp, Homo sapiens
catcttgccagtctccaaatcaatctgaatggtgtcattcaccttgatgaggggtcagggtagcggatg

SEQ ID NO: 4882 - DNA, 72 bp, Homo sapiens
tgtcactgattatgaaattgttaaagaggatgattattactgattacctctttgcattttggatcaaagaca

SEQ ID NO: 4883 - DNA, 80 bp, Homo sapiens
actcctgttattgtattttaatttgttaagaattggcattaaggaagaaagttatagcaagttgatatttttaaaggagt

SEQ ID NO: 4884 - DNA, 88 bp, Homo sapiens
ggcctttgtagacaccccatgtggagctagtctgaaaactctatagtttttctgtttggattatgtcctggggatgagctgcagggcc

SEQ ID NO: 4885 - DNA, 81 bp, Homo sapiens
gccttaaccagttgcaccatgtacagtgcaggatataaatgtcagcactgtgacagaggcgtgttgacactggttgagtgt

SEQ ID NO: 4886 - DNA, 90 bp, Homo sapiens
taagaattggactagaaataatcccattcacttactcttaggaactataataatagagaagaattggattatgacttatctaagcttttg

SEQ ID NO: 4887 - DNA, 61 bp, Homo sapiens
agtagcacagtatttttgtatgaaaagtgggagacttctgaacagtaattcatttaattgc

SEQ ID NO: 4888 - DNA, 84 bp, Homo sapiens
ccccactcccttgcaggctgcaggcactagggctctcaggaattgcagggactttggtgcccaagcaaatgcttgggcaggggg

SEQ ID NO: 4889 - DNA, 78 bp, Homo sapiens
gtgccttcaatgctgctttcttcctctctgtccaattatcctatttgcactcaaaaggaacgtcgtacttgaaggcat

SEQ ID NO: 4890 - DNA, 66 bp, Homo sapiens
cctcatccccctcgctcatgctgctgatagaggctgaggctgctttgggtgaggaagggggtgagg

SEQ ID NO: 4891 - DNA, 64 bp, Homo sapiens
ctgcgcctgtgtgtgagctaattaatctcagcccctttgggaaattagaacgccgcagccgcgg

SEQ ID NO: 4892 - DNA, 69 bp, Homo sapiens
gctgagcagtggggccagctcccgcccacccccaggagactggtgaggagagctgtccggctgagcagc

SEQ ID NO: 4893 - DNA, 76 bp, Homo sapiens
ggcaggcaggaagacaaccagctggatggtatccacatcgtgtgccatcaccaccagctgagtcttcttgttctcc

SEQ ID NO: 4894 - DNA, 88 bp, Homo sapiens
atcctttgtacaaatgaaaattactcttaattccttcagatttataataactctgtactttggtttcagggtgacatttgggaaggat

SEQ ID NO: 4895 - DNA, 84 bp, Homo sapiens
gccctttgtgtaataatctgccaacattcatggtgggtacattcactgtacccattctactgtggcactccattacgactgggt

SEQ ID NO: 4896 - DNA, 77 bp, Homo sapiens
gggtaggcacaggcagggctggggagcctccttctgcctttctagggcccgctcagcccttggccctgtgccttccc

SEQ ID NO: 4897 - DNA, 82 bp, Homo sapiens
agagcaaggaggacatgatgggggcgtgttccttgctatgtagctagctgcagcgtcccctttccctgcctctttctgctct

SEQ ID NO: 4898 - DNA, 86 bp, Homo sapiens
aaaatcaaaagataaaatgttctgggatggatttaagatccacttttaagaactcaaattatcccagtgtaaaacgtcatgatttt

SEQ ID NO: 4899 - DNA, 81 bp, Homo sapiens
tggcatcagtttgctacagtgagctcaaatcaaataggaaattatttgaaatgcatgtttcaaactgtgaggcaaactcca

SEQ ID NO: 4900 - DNA, 73 bp, Homo sapiens
ggtccccagggcccgcaagcagtgattcaccacaggaaagggaaggctgcagagtgacctggtgctggggacc

SEQ ID NO: 4901 - DNA, 73 bp, Homo sapiens
aggtggaaaaaagtgaaccagatatgatgcatctgaccctctgtcccatcccatctgggtccctttcccacct

SEQ ID NO: 4902 - DNA, 82 bp, Homo sapiens
gtttctgcagatggtttatatcctttccattaaactgtgggatttcacatgtatgggaggtgctaggcaaagatgcagaaac

SEQ ID NO: 4903 - DNA, 84 bp, Homo sapiens
aattcatgtgaaatacctactgcaggacaaagcatctgacggtttggaggatgtttctgtagtcctaggaatccacagtgaatt

SEQ ID NO: 4904 - DNA, 78 bp, Homo sapiens
atgggttctggctgggatttaaacatcttagctgctctaatttctctagagaaactaggagatcaagccaagtcccat

SEQ ID NO: 4905 - DNA, 76 bp, Homo sapiens
tccacatgcgtgtggtagcccaaggctttgttgtaggagcaatgactgttggtatgggctattccatgtatcggga

SEQ ID NO: 4906 - DNA, 90 bp, Homo sapiens
ttttaaagcaaaatggggattgaagggacttataatttctgttgtttctaattaaagtccctgaagatcatataccaaagtgtttgagaa

SEQ ID NO: 4907 - DNA, 75 bp, Homo sapiens
tatcactgctgcctttgctcaaataactctgataataatgagagattgattgagctttaagcagctcaagtgatg

SEQ ID NO: 4908 - DNA, 75 bp, Homo sapiens
caattacatgctgaatgcttttaaaatttaaagccctatattaagagagttttaaataaagcacagtagtaattg

SEQ ID NO: 4909 - DNA, 70 bp, Homo sapiens
aagcctcacaaaacctaggctggggtttggcaggagttcctcagccactgggtttttctgtgtgtggttt

SEQ ID NO: 4910 - DNA, 72 bp, Homo sapiens
gcatacaatgggctatacttatggaactgagagtctgagatccaaagtagagaaaatgcaacttttgtgtgc

SEQ ID NO: 4911 - DNA, 89 bp, Homo sapiens
tgagaaaggaaaattaaggaagtgcttatattgaagtaataagcctgctttgatattaacagaattgtcctcttaatttacttttctca

SEQ ID NO: 4912 - DNA, 79 bp, Homo sapiens
aggtgcagatggtgaaatagactctaacagtgctttattgctcacactgtctctagagttttaagttccaattgcacct

SEQ ID NO: 4913 - DNA, 85 bp, Homo sapiens
ctcaggctgtggcgctggcataagtcacgcctgctgcaggcttctgaaggcgggttggcaggtatgcccacgtcacattttgtag

SEQ ID NO: 4914 - DNA, 75 bp, Homo sapiens
ttgatggaatgctgtcacccagccatcaaacaagtgctcagcagggtattaaagcgggtgattttgtttgattaa

SEQ ID NO: 4915 - DNA, 86 bp, Homo sapiens
gggcagtgcagccaatgctctgtgatctgggagtgcatgaattttaggtcagctaaatcaggacacaaagctacagctgcgaaacc

SEQ ID NO: 4916 - DNA, 78 bp, Homo sapiens
ccatcaatgatgttcccccttgtatctctcaattacttgataatgaggagagttgggacttcaacatctttgaattgg

SEQ ID NO: 4917 - DNA, 66 bp, Homo sapiens
tgttagtgattttcatattacattagcaaatttaatctctgctcatgtgataggaagttactaaca

SEQ ID NO: 4918 - DNA, 71 bp, Homo sapiens
tccccaaaggggtcttcctctgaaatgtctgaaagcaagtccatttcagggacaggcaataggtttgggga

SEQ ID NO: 4919 - DNA, 68 bp, Homo sapiens
tagaaaaataattagtgttgtagtcttaagatttgtttctaaagttgatactgtgggttatttttgtg

SEQ ID NO: 4920 - DNA, 69 bp, Homo sapiens
tcctgatttagcttctagatcttgctgccttcccttagggagatggcctctcaaagctgaaggtcagga

SEQ ID NO: 4921 - DNA, 62 bp, Homo sapiens
agatctgcacatttcttctctttgcagaacatgtaaagagtggagagaagttgtgctgattt

SEQ ID NO: 4922 - DNA, 80 bp, Homo sapiens
tttgcttagagctgatgacttatgcctttcttgcgagttatgcagttagcaagcgactggggaatcagtcagcaagcaga

SEQ ID NO: 4923 - DNA, 82 bp, Homo sapiens
cattctcatcctatttatcttcacatgtttaagtttttggacttcccaaactaacttaaaactcccaaattcatgagcaatg

SEQ ID NO: 4924 - DNA, 72 bp, Homo sapiens
cctggggtcagtaaccataagaagccatggctcccagaaggctgcctggatctggttagtgaaggttccagg

SEQ ID NO: 4925 - DNA, 73 bp, Homo sapiens
ctgacctacatttgcccaatgggaggcggtactggggggcgggaccgtgacccagtttgggccaatgaggcag

SEQ ID NO: 4926 - DNA, 88 bp, Homo sapiens
gttacattcctgttttgccagttaggttggttccacagctaaaggcttggcacggaaatataaaaactctggacgacgggtgtgtagc

SEQ ID NO: 4927 - DNA, 77 bp, Homo sapiens
gagagaagaggaagggggcatagaggggaggggggcagagctgcagacaacccctcaaggccccacctccttcactc

SEQ ID NO: 4928 - DNA, 67 bp, Homo sapiens
ccccagcccccgcccacatccctggcctggtggacagggaatctgtgtgcggagagggcagtgaggg

SEQ ID NO: 4929 - DNA, 84 bp, Homo sapiens
gttgtcggctgactacagatgctgtgccctttgttttattttggaaaagaataaaggttgtaccatcttgtcatctgccataac

SEQ ID NO: 4930 - DNA, 83 bp, Homo sapiens
gctcagggaagatttgggagggagctgctaatggtccaagatggatccgtggctgcatctgcaacagcctgctcttccctggc

SEQ ID NO: 4931 - DNA, 77 bp, Homo sapiens
gactctgttggtattatgaagaaggctagagcaggactaacagggtttggcttttatcaaccttactaataaaagtc

SEQ ID NO: 4932 - DNA, 89 bp, Homo sapiens
gaggaacagccggtaatgccctcatggatggagcatctcagctgatgggagaaaacaggaccatgaccattcacaacggcatgttcttc

SEQ ID NO: 4933 - DNA, 85 bp, Homo sapiens
cacttttaaaggcccagctctgtttgctctgatgttcttttagccgaggctgtgttggggctggtgaactgactgggctttagtg

SEQ ID NO: 4934 - DNA, 67 bp, Homo sapiens
ttcagtctttacattagtgacttaaatctattcttggatatgttgtttaagtcctttgtgaactgaa

SEQ ID NO: 4935 - DNA, 70 bp, Homo sapiens
ggaagatgccttcggggaaaatggcggcgctgctaccgcaccgcctttgcctggaacacaggcagcttcc

SEQ ID NO: 4936 - DNA, 62 bp, Homo sapiens
aggagaaaataaatgtttgctgaataaattacgtaatgaatatagataattaatgtgctaat

SEQ ID NO: 4937 - DNA, 66 bp, Homo sapiens
gctcaggctcctcgctggccaggtccaaggggctactctcgtggatctgagccaaggaagcacagc

SEQ ID NO: 4938 - DNA, 66 bp, Homo sapiens
cttgagccgcaggcgggcacgggcctgggcaccccaggccttgcctcgagctgcagaggccacaag

SEQ ID NO: 4939 - DNA, 68 bp, Homo sapiens
agtacacatccttcttatcttcaaatgctactaagtatttagacagtataataatgatgatgtgtact

SEQ ID NO: 4940 - DNA, 66 bp, Homo sapiens; identical to SEQ ID NO: 4563

SEQ ID NO: 4941 - DNA, 82 bp, Homo sapiens
ggtggggatgaagcaggggctgctatggctaccagaggtgagctggtgatgtgagctgagctgtcccatgacactctccacc

SEQ ID NO: 4942 - DNA, 71 bp, Homo sapiens
caagtggagtacacccttgtggaaaatggaaggcagatgaaaacatgatgccaggcagtgaattcatttta

SEQ ID NO: 4943 - DNA, 76 bp, Homo sapiens
aaatggcagaattaaatgtagtttggtgaaaatgtttatcaagtattttcttaaacagtttataatttgcacattt

SEQ ID NO: 4944 - DNA, 64 bp, Homo sapiens
cctattttcatgtcagaacttggtaatgaactacatttatcaagcccgttctccatgagaaagg

SEQ ID NO: 4945 - DNA, 69 bp, Homo sapiens
gcgggggagaccgctcctgacccccaccccttcgtgggccacgaagtaggggagcggttcctcctccgc

SEQ ID NO: 4946 - DNA, 60 bp, Homo sapiens
agttgcccagatgtatttattgccaaataacacagggtacttggatacatctggacagcc

SEQ ID NO: 4947 - DNA, 70 bp, Homo sapiens
cctgtgagcttttgtttgaattctctaatgtggtttttggcattaaataggattttaaaagctaaatagg

SEQ ID NO: 4948 - DNA, 75 bp, Homo sapiens
gatccacatcactgccctctctgatggaagtccctttcagggacttccctgagacttggggctcctgagtgtttc

SEQ ID NO: 4949 - DNA, 77 bp, Homo sapiens
gctgtaggcaagtgactatcctctgtgttgtagacaggaggatcctgtgtcaagaaaacattgagacttgcctaagc

SEQ ID NO: 4950 - DNA, 80 bp, Homo sapiens
ggttctgagatccctcaagcatgaaaggaaggataaggaatcaaatcctttctctacttaatagggaatgtctcagaact

SEQ ID NO: 4951 - DNA, 66 bp, Homo sapiens
gatgattttgtacaactccagtgatacattgtgtggtgatgtgtcatcagcttgacaagtttcatc

SEQ ID NO: 4952 - DNA, 68 bp, Homo sapiens
ccctggggaactatgtgctctgtggtctgggcggatctgctggggccagagtggggttcatttcgggg

SEQ ID NO: 4953 - DNA, 66 bp, Homo sapiens
tcagtgttttatagtatctcttcactgtccattggatctggagctacaagcatgcataaaacctga

SEQ ID NO: 4954 - DNA, 87 bp, Homo sapiens
gaagagaatctgctgaatttttgcatcttatccagcatcaatcactttgattaggatctcactccatgaaccaggcagcttctcttc

SEQ ID NO: 4955 - DNA, 61 bp, Homo sapiens
agcagctggtccaggtccacgccacggtaggtgaacctgcggaaggtctgcttcttctgct

SEQ ID NO: 4956 - DNA, 74 bp, Homo sapiens
ggaacttccacttcttttttaaaaccttggtggaaactgtgctggcaaggcaaacagggaggagaggaagctcc

SEQ ID NO: 4957 - DNA, 60 bp, Homo sapiens
agcatcacagaaagctaccgtgactgccttcatatcacattgttagattccagtggtgcc

SEQ ID NO: 4958 - DNA, 72 bp, Homo sapiens
ctcacagagctgaccaagaccatatctcgactgcaaagcgaggtagccggtgtgcggtgaactctggcagag

SEQ ID NO: 4959 - DNA, 62 bp, Homo sapiens
ggcagcaccttcaggttctggtcactctggatctcgttggtagagatctggttgatgatgcg

SEQ ID NO: 4960 - DNA, 71 bp, Homo sapiens
tcctgcagtcaagcttccacacagacctggggctctctggatgccaccctgtgtaggggaggatggcagga

SEQ ID NO: 4961 - DNA, 79 bp, Homo sapiens
cctgaaagggaatgtggctttggttggatttcactgtaattttggttgagagaaagcccagccagagttcaagctcagg

SEQ ID NO: 4962 - DNA, 87 bp, Homo sapiens
ttccttgtgctgaccccttgaagttagttttttaaaataagtcaccagttttgaaggactatccttttttagaccatatacaaggaa

SEQ ID NO: 4963 - DNA, 70 bp, Homo sapiens
atacctggtgttttctttagactttattctgccttctgctgggtaaatgtcatggaaatgcacttagtga

SEQ ID NO: 4964 - DNA, 78 bp, Homo sapiens
acagtatcgtggtttgtgccaaaatccaaagcaatcttcctgctaaggccactggacacagaatctgtgtgatgctgt

SEQ ID NO: 4965 - DNA, 75 bp, Homo sapiens
ctggcaggatggatggtaatttttattccccagcttccctacttcctgctgggagaaattccatcctcctaccag

SEQ ID NO: 4966 - DNA, 66 bp, Homo sapiens
acaatgggcggcgcgagcgtccaggcgctgggctctagctgaggccggcgcttagcggcccactgt

SEQ ID NO: 4967 - DNA, 61 bp, Homo sapiens
agcagtccagattgactggaacacaccacccccagccaccaccatccaagttttccctggt

SEQ ID NO: 4968 - DNA, 78 bp, Homo sapiens
tgattaactctgtgattacattataattgtgggccacctaagtacacagtaattatcacaaaaatcgcagggtgatta

SEQ ID NO: 4969 - DNA, 69 bp, Homo sapiens
tagctttcagacaagcacagaggatagaataactctttctacccttctatgcttgcatgacaaaagctg

SEQ ID NO: 4970 - DNA, 62 bp, Homo sapiens
aggatcccggtacaggtgaccggcgtcctgcagggcaggtgaccggccttgcattggatccc

SEQ ID NO: 4971 - DNA, 70 bp, Homo sapiens
tttattagaggaaagcaatctagttccaattctggttctccggagttactggattgtgtctgaggataaa

SEQ ID NO: 4972 - DNA, 90 bp, Homo sapiens
aatccatttcaacatcacattacagatctatgacttacaggtaatttctgtcatttaaatatgagggtgagctgatggctgaattggatt

SEQ ID NO: 4973 - DNA, 83 bp, Homo sapiens
gctcaacttgccagctgaagggaagctcctggctgagccccagcaccctctgttggagcttctggtcagcctggccaataagc

SEQ ID NO: 4974 - DNA, 83 bp, Homo sapiens
ttcaatgtggtgctgattcagtcatcgcatcactgaggcaacattcttctgtgaaagctatttatgtcccggcaccatttgaa

SEQ ID NO: 4975 - DNA, 84 bp, Homo sapiens
ctgtggaaaacattaacgcaatatggtcctgtatcacttactgacaaggacaacagttgcaccaaattctaatgtatttcacag

SEQ ID NO: 4976 - DNA, 79 bp, Homo sapiens
tgtgggttcctcctaaagatcaaagaggaggactctgggatcctctaccgctgccttgattttgcggaggaaagtcaca

SEQ ID NO: 4977 - DNA, 81 bp, Homo sapiens
gtaaagcaaagtagatcttgtgaaacgcataaattaacatttggaataagatttatgcatcataatgtcactccgttttat

SEQ ID NO: 4978 - DNA, 86 bp, Homo sapiens
gccatgaatgagtacagtgtttggtactagtcaacaagatggatgttgtttcgtttcggctccacgcaccgtaaacattctgtggc

SEQ ID NO: 4979 - DNA, 83 bp, Homo sapiens
gacttggaaggtgagccctctggggacatggggccgctggtgaccgactcggttttgtccttagaggtatcaacatccgtgtc

SEQ ID NO: 4980 - DNA, 82 bp, Homo sapiens; identical to SEQ ID NO: 4455

SEQ ID NO: 4981 - DNA, 73 bp, Homo sapiens
cagagtctatagctgttgatagctcaggaactaaattttgtagtggctcctgggataagatgctaaagatctg

SEQ ID NO: 4982 - DNA, 72 bp, Homo sapiens
ttcattgtggctatttctcaagatgaaatttttattgttctaatggatttcatcagaaatgtgtataatgga

SEQ ID NO: 4983 - DNA, 80 bp, Homo sapiens
ttgcttaattaatcagcctgctcggggtgggtgcagaggatctctgtgagcatctgacccaaccagctcctgatgggcaa

SEQ ID NO: 4984 - DNA, 73 bp, Homo sapiens
ctttttctctctgctgggaaaccttgcttgacttcatgtccagtgtttggtatccaaagacggggaggaggag

SEQ ID NO: 4985 - DNA, 80 bp, Homo sapiens
gaaggaaacacatcaaagagactatgaagaggctgtaggagatctgcagtcgctttgtcatttctgaagatgtttgctac

SEQ ID NO: 4986 - DNA, 85 bp, Homo sapiens
catagcttgtagggttagtgttgatgtatttccattacttgaaacatttaatggaagtagtttaacagttcacttacatattgtg

SEQ ID NO: 4987 - DNA, 80 bp, Homo sapiens
cagcacaaactacaagctagcaattctcaagacagcatgagctgttttttagtgtcagctatggtcagaagcgtgtgttg

SEQ ID NO: 4988 - DNA, 79 bp, Homo sapiens
gcattgtagggcggggtggtgggccaaagttaggacactgcgtaaaacaggccatcccaccacctctacctgctcatgc

SEQ ID NO: 4989 - DNA, 79 bp, Homo sapiens
tcactcctggaaccttcactaaccagatccaggcagccttccgggagccatggcttgtggttactgaccccagggctga

SEQ ID NO: 4990 - DNA, 71 bp, Homo sapiens
gtataagcagaattgtataggcaggaaattaagatactttggaaaacttgctataatacaaatgattatac

SEQ ID NO: 4991 - DNA, 87 bp, Homo sapiens
gggtgtcacttttctgacagcaaatttcacacatttgaactaacaagcttcaagttgtggccatcagctggcttctttgggacacct

SEQ ID NO: 4992 - DNA, 60 bp, Homo sapiens
agaaacagaacagaaaatgttcagaatattttcaaatttgtcagattcttttatgtttcc

SEQ ID NO: 4993 - DNA, 79 bp, Homo sapiens
ccagggtttcttgaacaaagtaaaaggccttgtcttcagattgccaggttggaggctggcttgtggaagaagcccctgg

SEQ ID NO: 4994 - DNA, 80 bp, Homo sapiens
gtgttctgcatgtctgattccgttgcgctgaatttggttaatatccgtcacttcggcgatcggcagttgctgcagggcat

SEQ ID NO: 4995 - DNA, 77 bp, Homo sapiens
cttttaaaagaagggctatttaaggaattcacttggtagtactttgctttagcttttaaatggcttgattttaaagg

SEQ ID NO: 4996 - DNA, 72 bp, Homo sapiens
gggcgtctggcctgcctgcggccaggacgtgcagctgtgcacacacatggcctgcacacgcgccaggcgcct

SEQ ID NO: 4997 - DNA, 68 bp, Homo sapiens
ttcagggtggtttctgttttgctttttgtgaggagcaactcataaaaatgataccaaactcctctgaa

SEQ ID NO: 4998 - DNA, 74 bp, Homo sapiens
gaatgattgctcaacttgaaaaccccctgggcgggtgtctggggtggtttggatcattgcgcagcatttcattc

SEQ ID NO: 4999 - DNA, 84 bp, Homo sapiens
tggtagcagcagcgggggtggctgggaagtgaaacggagccagcggctgaggaggggccccagcagcccccgaaggccctatca

SEQ ID NO: 5000 - DNA, 76 bp, Homo sapiens
agaaccaggagctggactcttctgctgggtatcttcttctgtgcttagcaagataacctcgattcctgctggttct

SEQ ID NO: 5001 - DNA, 88 bp, Homo sapiens
gcggctccaggaggcaggggcccttgcttcaggacctcggcgtaagagatggcacctgaggcagcaaagaggccgccgcctccgccgc

SEQ ID NO: 5002 - DNA, 63 bp, Homo sapiens
tttttattttaagcttagtatgatctgattttccaaatcatatcataaagccctaaaacaata

SEQ ID NO: 5003 - DNA, 88 bp, Homo sapiens
ataatatgcagttgtagcatatgcttttcttgttttccacctccagtgtggaccagaaacacataattgctgcttttactcatgttat

SEQ ID NO: 5004 - DNA, 67 bp, Homo sapiens
ctgaggactgcaaaatattttacaaatattatcttgccaaatgagtatgtgtaaaaattgtcctcag

SEQ ID NO: 5005 - DNA, 84 bp, Homo sapiens
tcttctcaaaggactgggcaatcctcttggggttggtgactgtcaggtcatcccccacaatctggatgtccacccctgagagga

SEQ ID NO: 5006 - DNA, 84 bp, Homo sapiens
tggactctgctgcatttaatgagctcttggtttcagatacattggtgtccggtggtcaggccagttgctaaatggagcaggcca

SEQ ID NO: 5007 - DNA, 81 bp, Homo sapiens
gatgcttcaagagctttgagctgcttagcagtagtactagatgattagcagtttcaatttttatcttctcttgaagtgatc

SEQ ID NO: 5008 - DNA, 80 bp, Homo sapiens
gtcagtcattgttgcttcatgttaactacttgcccaagaaacacattcatcttgtggaggagataatgagcaagactggc

SEQ ID NO: 5009 - DNA, 82 bp, Homo sapiens
atgatgtcaccgtaatgcattttgggaatagccatgtggtttatacacacttgagttgctttgaatgcaaacctgacatcat

SEQ ID NO: 5010 - DNA, 89 bp, Homo sapiens
ctactgggttcacagcttacaactaggtatcattacttgtacattaggtataattataggttgtggaagccaaaaagagaattcagtag

SEQ ID NO: 5011 - DNA, 80 bp, Homo sapiens
tactgattctttatgtgcttccaatttgattgctttggccttccaaacaaataaatggcagtaccagaaacctattagta

SEQ ID NO: 5012 - DNA, 88 bp, Homo sapiens
gctgggcccaggatgccctggattcctctgtcaatgttggcattagacaggaactatcaggagctggaaataggctgcggggcccggc

SEQ ID NO: 5013 - DNA, 83 bp, Homo sapiens
ggccagaagagtagaaatattgagacttgggtttatctgcctcacatcaggtacatcaagttctggatggctgcccactggcc

SEQ ID NO: 5014 - DNA, 67 bp, Homo sapiens
atgagtgtataattcccttgagcttcataaaccacaaaaatgaagctcaagtggtttgtgtagtcat

SEQ ID NO: 5015 - DNA, 73 bp, Homo sapiens
gtgtcgcaagttgaggtaggtaatatcttgactatagaagagatgctcaggaacctcctcgaggctgtaacac

SEQ ID NO: 5016 - DNA, 83 bp, Homo sapiens
cgtcctccgggaataggcaggaacctcggcccggcctggccttggcggtgccggccgagggctgccgcgcaccgggggcagcg

SEQ ID NO: 5017 - DNA, 83 bp, Homo sapiens
agagacctctgggtttctcttatgttcttctctgcatgtctgcacaaagaaggaataagcagacacctttccctctggtttct

SEQ ID NO: 5018 - DNA, 80 bp, Homo sapiens
aggttttattgatgctgatgggggtaggaaaggtccccagaagcatgggggctgagtcagtcagcaaatgcgtaaggcct

SEQ ID NO: 5019 - DNA, 88 bp, Homo sapiens
acaagtatacattaagccctgcaaaagtgcttatatgctatttagtgctgagggtgctggagcagggaacacatttgagtatgtctgt

SEQ ID NO: 5020 - DNA, 76 bp, Homo sapiens
gcgctcagggcgctggggaagacgcccggcgcgccgggggccagcggccgaggcgcggcccgtgcgccctgagcgc

SEQ ID NO: 5021 - DNA, 77 bp, Homo sapiens
tatatatagagagagatactataaggaagtttatttcttaggaagtgcactgaataatgtatttcttttacagtgta

SEQ ID NO: 5022 - DNA, 79 bp, Homo sapiens
aactgggtatgtcactaagaacctgctggcaaccccgatcgtggtgggcaaggaggttcttgctgtgatcatggcagtt

SEQ ID NO: 5023 - DNA, 69 bp, Homo sapiens
cagaaagggccttgtgtttatagctttgtcaagtaaatttggacgcagctggagcacaggccctgtttg

SEQ ID NO: 5024 - DNA, 66 bp, Homo sapiens
ttgtaaaataatattcgcatacaaatttgcaattcaaatttgatgtcttatgagtgcattttgcag

SEQ ID NO: 5025 - DNA, 77 bp, Homo sapiens
gggcgcttttttcttccatctggctttatttatttatttagactagaaaagcgagccggcttggagggagtccgccc

SEQ ID NO: 5026 - DNA, 79 bp, Homo sapiens
ccagaggctctggaggcgtggcagcctgggggcagggccagcagcatctgtcctggttcccacactctggcctctctgg

SEQ ID NO: 5027 - DNA, 72 bp, Homo sapiens
cccaactggccaaggaagcatggagagtccctgagagccatcaggagagtccgtggcttttggagtgttggg

SEQ ID NO: 5028 - DNA, 81 bp, Homo sapiens
gtcctgaccaattccgtttgacactaatgttactctacatgagtagagttcaatgagggttgatatgggatgtgacagggc

SEQ ID NO: 5029 - DNA, 85 bp, Homo sapiens
tcttccttggctttcacaggttcagtgttgccagggtcacgcctcaccaccatattcaatactgacatctggggaccaagtaaga

SEQ ID NO: 5030 - DNA, 81 bp, Homo sapiens
ctgggaattacagatgggatccagtaaaagacactgtattaattatattgttttccatggaacttttctaaggttgcccag

SEQ ID NO: 5031 - DNA, 68 bp, Homo sapiens
ccttatagttgatgacgacgttgttcttggctgtcatgtagtcggctatgttgtggtccacgatgagg

SEQ ID NO: 5032 - DNA, 90 bp, Homo sapiens
gttattagctgacacaaattcagccacattctgaatattttttgttcacctttcagactttgtaatactggacatgtcagtgtaaataac

SEQ ID NO: 5033 - DNA, 79 bp, Homo sapiens
gcttaattaccagtagcattatgctgtctatattgttaaatgtgaactctgcaattaagatgtaaatttggttgtgagc

SEQ ID NO: 5034 - DNA, 84 bp, Homo sapiens
ggagaactggctcttggccactgtgaggggtacagctttgccactcaaatataccttattatggcattcagggagccagggtcc

SEQ ID NO: 5035 - DNA, 65 bp, Homo sapiens
acctgagactgacggatgagcaggtggccctggtgcggcggctgcagagtggccagtttggggat

SEQ ID NO: 5036 - DNA, 76 bp, Homo sapiens
aaagctcatttaaagtggtggattaaatgctatgctcttttactatctatagaaagcaccaggcttaatgtgtctt

SEQ ID NO: 5037 - DNA, 81 bp, Homo sapiens
ggggtttggcgggttggggcgggctccaggaggcagttacgtaaacgccctcaagcccccgcccttgctccccctcacccc

SEQ ID NO: 5038 - DNA, 89 bp, Homo sapiens
gggaacatggtgttctcagtgtaataagatgtattgtaagtccaaggaaaatgcatcttggtggggctgaccttattgcaccccttccc

SEQ ID NO: 5039 - DNA, 60 bp, Homo sapiens
agatgcacacacatgtgaatgcatgtgcatgcctgtgtgtgcatacatgtgtgtgttact

SEQ ID NO: 5040 - DNA, 62 bp, Homo sapiens
agcaacacaggtgcatttaagaaaaaccgagtgcgagacagtcaagtcgatgatttgtttct

SEQ ID NO: 5041 - DNA, 78 bp, Homo sapiens
tggttttgtttaccatgaaagacctttactttattttcattcttggaggaggtggggaggaggagggaaggaaagcca

SEQ ID NO: 5042 - DNA, 74 bp, Homo sapiens
ctagatggctggtgtacttcagtgattcctgtgcctttatgtagacatagaaagtcatgaattacaccatctag

SEQ ID NO: 5043 - DNA, 85 bp, Homo sapiens
ggtggtgtcccactacctggtgggggtacgcttcacctggaggatgacatcctactgagcccctgcttccagtgggacagccgct

SEQ ID NO: 5044 - DNA, 68 bp, Homo sapiens
gatcaacaggcttattagaagaatgaactaaggtgtctaccatgattatttttctaagctggttggtt

SEQ ID NO: 5045 - DNA, 65 bp, Homo sapiens
gttggaggatgtgagcgagttggaggatttaatcttccatacactgagtgctacgatcctgtaac

SEQ ID NO: 5046 - DNA, 88 bp, Homo sapiens
ccacagggagttgggagccctcatgctgcctgggaacccctgcaggaagtggggcggctggcagcagggctagctggctctctggagg

SEQ ID NO: 5047 - DNA, 83 bp, Homo sapiens
catcacacccctaaaacacataataactacacacatcttggtaaatagattgtggtagaatatgatgttcattgtttgtgatg

SEQ ID NO: 5048 - DNA, 82 bp, Homo sapiens
tgggagcaatatagaccagagctggtaaggaaaggtttggtgttggcattttaattcttcaggcttctggtcattgttacca

SEQ ID NO: 5049 - DNA, 69 bp, Homo sapiens
gaggggagggctcctggggccaggcgattcaagtagactggcccgccccttgggggattccctccgctc

SEQ ID NO: 5050 - DNA, 81 bp, Homo sapiens
ttcttcaaccttgtttaatttagtgagttctaggagaagatcacacctctcctaacactcataaagagaatttgtgaggaa

SEQ ID NO: 5051 - DNA, 68 bp, Homo sapiens
tggcttgatgtttaacgtgtgttttattgttgttggcaccagaaaagctcatgttctatgttatgtca

SEQ ID NO: 5052 - DNA, 62 bp, Homo sapiens
tagaaaggaagagttagaagaagatcacaaatgtagtcattttcctgatttttcttattctg

SEQ ID NO: 5053 - DNA, 86 bp, Homo sapiens
ttgtagctgctatttatagcaatatcagcattcaagttttatgtaaaaatagcaaagtgaagctactggtataatagtagctataa

SEQ ID NO: 5054 - DNA, 89 bp, Homo sapiens
cagccacagccagtggaagggggcaggttaatgcggtgggtgaataccacctgcttctcccctccttccactgtgtgctcgtaaagctg

SEQ ID NO: 5055 - DNA, 74 bp, Homo sapiens
catgtaaaagtctggatatactttttcacggattgtttaaaatataagctccaagattgatccaggcatatatg

SEQ ID NO: 5056 - DNA, 76 bp, Homo sapiens
ttgactgaccttcaggggacctaaccgtaggtgattgatgaaatggctacaggtttaagcagaaggtcagcttcaa

SEQ ID NO: 5057 - DNA, 81 bp, Homo sapiens
aagaaaattcaagttaaaagcaatacttagaagatgcgcataaaattcttttaaagactgcttaaaatttgtttccttctt

SEQ ID NO: 5058 - DNA, 88 bp, Homo sapiens
gagggtcttataaagcaacagcaaccttccctaaagtgatttttcactgagacagctactttagaaggatgctgtaacactgaccctc

SEQ ID NO: 5059 - DNA, 73 bp, Homo sapiens
aaggtaaatattgactctcgctttgggtcaataaattctgatccattgctcaagagaagtcaatatctacttt

SEQ ID NO: 5060 - DNA, 86 bp, Homo sapiens
atgggcctaatctcatttgtttcactcaggcagaacacttaggaaccgcagtgggagttttgcttgagtgaagagaataggcttgt

SEQ ID NO: 5061 - DNA, 79 bp, Homo sapiens
gcccagggccaggagtttgctgtgttttctgtatggggccatggcaaccagggaggaaatcgtgagctagggactgggc

SEQ ID NO: 5062 - DNA, 87 bp, Homo sapiens
tttatatattcatagaaaaccagcatacaagtagatgatatcacaatttgatatttatgaaatgccagttttccataaatatagaaa

SEQ ID NO: 5063 - DNA, 86 bp, Homo sapiens
cattggcattttcgaaaaagagagatttaggcataatcagtgttggttgtggctggatgccctgttacaattaagaaatgccaatg

SEQ ID NO: 5064 - DNA, 72 bp, Homo sapiens
gtgtccagaggcactgcagagttgcctgctctaactcttgacagttgagtggggcatgcagcttctggacat

SEQ ID NO: 5065 - DNA, 88 bp, Homo sapiens
agtccaataaatgtcagttaaacttgctgctcacagtttctatggaaaccccttaagttaggagtggaacacagacattttttggact

SEQ ID NO: 5066 - DNA, 82 bp, Homo sapiens
gccccagtgtctcctgctctggttagccccctgctgctctaatagaggaggagggagattaaatgagcaatgatggtgaggt

SEQ ID NO: 5067 - DNA, 87 bp, Homo sapiens
tctctcattacttggcaattcctttctctaatttcttgtgacacacggtgcttaaatccacaagaaatgtgaggtaaggctgagaga

SEQ ID NO: 5068 - DNA, 76 bp, Homo sapiens
tcaagtcactcagaggccttcttttaatctcttggatcattattgcaaagataaaagcaggtttctgaaggagtga

SEQ ID NO: 5069 - DNA, 74 bp, Homo sapiens
ggttgaaatcagaggagtctgaattttcaggccagaaggaaccttagaaatcagattttgacttcagttcaatc

SEQ ID NO: 5070 - DNA, 84 bp, Homo sapiens
gagggactgaagaaaggaaacatattctcttggacacataaaggcgccattcaggaagaatagatttgtttttactcagccctt

SEQ ID NO: 5071 - DNA, 65 bp, Homo sapiens
gctggtcagagtccagtctactttccacttttaaaactggaataggctgagtcttctgatcttgc

SEQ ID NO: 5072 - DNA, 83 bp, Homo sapiens
agggctcgaaccagctattagtgtctatttgcactgcatgaaaacaaaatttaatgtaaagacgcttatagcttgcctaccct

SEQ ID NO: 5073 - DNA, 77 bp, Homo sapiens
gggagttcaaacctcaacacgatgagccatagcaggatcacggtttgatttgctgtggccatgaagtctgaatcacc

SEQ ID NO: 5074 - DNA, 87 bp, Homo sapiens
acactgtaagattttcctgtaatccccaaataataattactgtcaggcttcagaatgaggagagcttgcagaattttcttgcagtgt

SEQ ID NO: 5075 - DNA, 66 bp, Homo sapiens
ccttgtctgaccacatctgagaaacttgactttgatttcagattaggtttctcagaaaggtttagg

SEQ ID NO: 5076 - DNA, 60 bp, Homo sapiens
cagaggacgctgaagtttggattgcaaaagacgagatggacagatttcatattttcattg

SEQ ID NO: 5077 - DNA, 79 bp, Homo sapiens
cttcatgggaaatgcttagttgagtccactgaggcagcttaatcaaaagggcactaggcatgaatcctgtataatgaag

SEQ ID NO: 5078 - DNA, 71 bp, Homo sapiens
gaagttttatctgattggcaaaatggacccagatatgagttcaaggattgagtacagtttgatgaaatttc

SEQ ID NO: 5079 - DNA, 64 bp, Homo sapiens
agctggttgtaagtctgcactgtatcattggtgatgtagtagtggctggctatacggcccagtt

SEQ ID NO: 5080 - DNA, 68 bp, Homo sapiens
gggagcttggtgaattttttgtctttaaaataaagctgtttttgaggtataagagaagcttggttttt

SEQ ID NO: 5081 - DNA, 73 bp, Homo sapiens
cctggcgtgaggggagcctccggggagcgggtctggagatagttctccccaaggaagggccccatacgccggg

SEQ ID NO: 5082 - DNA, 85 bp, Homo sapiens
ggggcctttctgatccagttggcccttgcctgtacatcctctccacaggtatcaaaaatgagggcagcacggcctggagggcccc

SEQ ID NO: 5083 - DNA, 72 bp, Homo sapiens
cccagaattctagtaatgagggagacaggttatgccaagcctgcttctcccaggatgcactgggagcctggg

SEQ ID NO: 5084 - DNA, 71 bp, Homo sapiens
catgaagagcttttaattttgcaattaatagaatgtctgttttattttgcaccaaatttaagcttacaatg

SEQ ID NO: 5085 - DNA, 86 bp, Homo sapiens
gttttgaaggatgcggtgtggagccagaggatgtgtgggaggggtttctctaacactgacttctattccatgagctttttcaaggc

SEQ ID NO: 5086 - DNA, 79 bp, Homo sapiens
gaggttggacaggcttctccacactgagctttacaggcccgctccctcccctgcagagctcacaagccctgccagcttt

SEQ ID NO: 5087 - DNA, 77 bp, Homo sapiens
tggcatgaatcatgccactgtttctgtgggcctgaatgcccttccctcagatgattctggtttggtttggtttgcca

SEQ ID NO: 5088 - DNA, 72 bp, Homo sapiens
cctctctcttctactcacatctgctccctgggagtcacaggaacagcagaatgatgacgttggaagggaagg

SEQ ID NO: 5089 - DNA, 88 bp, Homo sapiens
caaaatagagattggcaaaccggtgtagctgctcaaaaatgtttttggggacgaaggacaacacggtgtacttgctggtcttgatttg

SEQ ID NO: 5090 - DNA, 67 bp, Homo sapiens
cagtgacaaagccatttactttcattgtaaaacaatgaagaatgtgaacaacttgattttgtcattg

SEQ ID NO: 5091 - DNA, 69 bp, Homo sapiens
ggaaaaggctgaatttgagattgggcattttaaacaaaatctctaaaatacaagttacagtcactttcc

SEQ ID NO: 5092 - DNA, 78 bp, Homo sapiens
gcttttcatgggtatatagtggctttccattgaggttttcactctttgaaggaggtcatttataccaatgagatctgt

SEQ ID NO: 5093 - DNA, 77 bp, Homo sapiens
ggcaggggaggagggctctggtctgtgtcaggttctccagcaggatgcctgactctaagtgcttcctcccacctgcc

SEQ ID NO: 5094 - DNA, 75 bp, Homo sapiens
gtcatgccctgcgtagcctttggtgggatccaaaaactggcgtccaatcaggcacgcaaagaagaaggtatagac

SEQ ID NO: 5095 - DNA, 82 bp, Homo sapiens
tttataatttatcaattacctactccgaaagttcctaaagaaacttattgtcttgttggagaggttactcatatattatgaa

SEQ ID NO: 5096 - DNA, 85 bp, Homo sapiens
cagcatgaatgggttttggattaagaacttggtaacaaagcagattaactctttcctcacttctttctttcatcccttcatgttg

SEQ ID NO: 5097 - DNA, 75 bp, Homo sapiens
gaaggagaaacttgaaccagacctttgacctgtcgtggggtcagagatttcctctgtctgtgttcggactccttt

SEQ ID NO: 5098 - DNA, 85 bp, Homo sapiens
gtatataggacagttaggaagactatgtatatgattatatttaattatttgcatggtagagatttataatttgttcttaatttgc

SEQ ID NO: 5099 - DNA, 63 bp, Homo sapiens
atgtgtatatgtactaacattgtatataatatccttagatgtgtatacaatacatatatacat

SEQ ID NO: 5100 - DNA, 61 bp, Homo sapiens
gctagcagaggatggtttccatccatcaacctctgggttatgggcccataggtatgcttcc

SEQ ID NO: 5101 - DNA, 67 bp, Homo sapiens
tgtgtggggttctgccaagacaatgtttaccagctcttgataacacatttctcacagaccacacaca

SEQ ID NO: 5102 - DNA, 69 bp, Homo sapiens
ctctaaagtacacattattaaagtctattaaagtctgtatttagcagcattactaatgtgcctttgggg

SEQ ID NO: 5103 - DNA, 86 bp, Homo sapiens
agctgtggggaaagtcttccagggcaattttcggggcaaacagttcttttgcaattatggaaagagccaaggtcacaccccaagct

SEQ ID NO: 5104 - DNA, 80 bp, Homo sapiens
gaggctcaaggcagagtgtgttgggtgaccctgggtagggcttggttggccacttaccacatggttgccactggggcctt

SEQ ID NO: 5105 - DNA, 67 bp, Homo sapiens
tctcttagtctgtgctggtttcttaacagtggacagtcccagatgttgaagtcagcacaacaagaga

SEQ ID NO: 5106 - DNA, 86 bp, Homo sapiens
ttgtaaattgttccagcaaaaattacagcatcgatggctgactttaaatgtctgtacgactgtctgccttgctgggctatttatag

SEQ ID NO: 5107 - DNA, 68 bp, Homo sapiens
ggcttccatgtactgcagtaattttgaattggatatgttatgtccaaattgacagtagtgattaagcc

SEQ ID NO: 5108 - DNA, 69 bp, Homo sapiens
acagcgcgcacgctgctggccatgtccagctcgcccgagagctgcgtggccatgcgccgctcgggctgt

SEQ ID NO: 5109 - DNA, 70 bp, Homo sapiens
tgtgaatatctgatcgatggggccagttggctgggatccagctaagccagccatgttgttagatgtagca

SEQ ID NO: 5110 - DNA, 88 bp, Homo sapiens
agcttttcattaaagctctgcggggagttttctccagtattagcatttttcagactctcctatcagcagcgcttcgaggataaaagct

SEQ ID NO: 5111 - DNA, 82 bp, Homo sapiens
tcactcctggaaccttcactaaccacatccaggcagccttccaagagccacggcttcttgtggttactgaccccagggctga

SEQ ID NO: 5112 - DNA, 80 bp, Homo sapiens
tgttaaaatctttaaaggccaaaacatgtgctatgttactcaggcatatttttccctaggattttaaagtaattttgaca

SEQ ID NO: 5113 - DNA, 78 bp, Homo sapiens
ggaaatagctggacagaaatcagtgtacatttcatatgagagatttaagaaatttgccctgaagcatccagcatatcc

SEQ ID NO: 5114 - DNA, 84 bp, Homo sapiens
tgctagaaatcttatactttgagtaataagctactagaattactagattagtaaaaatttgaagagttagattttaaaatagca

SEQ ID NO: 5115 - DNA, 85 bp, Homo sapiens
cacatcgccaatgttcttacaaagaaggaaatatacaaagcaatcgcctacattttcttactttcacaaggacatttgctaagtg

SEQ ID NO: 5116 - DNA, 73 bp, Homo sapiens
ggataatggattagtggaagttagcttgtgaatttttcttaaaaataaaactccaactctattaatccatgcc

SEQ ID NO: 5117 - DNA, 79 bp, Homo sapiens
ttatccacttttgctgaagatattttttattgaatcaaagattgagttacaattatacttttcttacctaagtggataa

SEQ ID NO: 5118 - DNA, 89 bp, Homo sapiens
ttgacagagattcatacaaggaaggaaaggtatggcaggatggatgttcacgctgtttataaatccttgctattagatgaaactgtcaa

SEQ ID NO: 5119 - DNA, 78 bp, Homo sapiens
tagccagagcccttcactgccatgatagctggggcttcaccagtctgtctactgtggtgatctgtagacttctggttg

SEQ ID NO: 5120 - DNA, 83 bp, Homo sapiens
cgcctgtgcagatggcaagatccgaatttacaatttcctcaacgggaactgtatgaaggtgttaaaagccaatggcagaggtg

SEQ ID NO: 5121 - DNA, 69 bp, Homo sapiens
caggcggcaccatgctgtccatgacgtacagcgagagtctgcggagcgtgagcagcaggtgccactctg

SEQ ID NO: 5122 - DNA, 81 bp, Homo sapiens
tatttcacagctgtgtttttgtagctgtgaaatttagtcctccgagtatatcttagctatttacattttagctgtgaaata

SEQ ID NO: 5123 - DNA, 72 bp, Homo sapiens
aagtggaacatgtggataaaaagatgaattgcccactatcttggagcctcattttaatatttaattttactt

SEQ ID NO: 5124 - DNA, 87 bp, Homo sapiens
caatggttttaaaaggttatctttagatttattactcattaatctgactcaaatttatcagcagagaaggcctatgtaaaactattg

SEQ ID NO: 5125 - DNA, 90 bp, Homo sapiens
ggtctctctggtagtcgttgaggttatgttataaattatgcattgaagagatgcctttggtaacacgtggccttaatgcaactttagact

SEQ ID NO: 5126 - DNA, 61 bp, Homo sapiens
ggaagcacattcatttttaaagtgttaatgcgcccaatccaagagacagtaatgtgcttcc

SEQ ID NO: 5127 - DNA, 74 bp, Homo sapiens
gaggagcaggaagaggctctcagggggcatttgtttcatgcagagccatggagccaaagtcttcctggctgctt

SEQ ID NO: 5128 - DNA, 78 bp, Homo sapiens
ccacgtgggcagaattctgtgcaggcagcagaaaagacagccaatctgtcctttctctgaggtgcagggcccctgtgg

SEQ ID NO: 5129 - DNA, 84 bp, Homo sapiens
ggccgaaatgcattcaaaacaattctgctgtgatagtaaaaaatatatatccatgctgtgcattcccagaagagcattttggcc

SEQ ID NO: 5130 - DNA, 84 bp, Homo sapiens
ttccaggctatgtcaactgttctgaagacaatgttgttaagtatcagatttggcagatcagatagataatgatgtgccttggaa

SEQ ID NO: 5131 - DNA, 76 bp, Homo sapiens
tcaatggcacagagaatagctccacagcccaagctgctgtacaagcacttggtctggtcagctccatgtctattga

SEQ ID NO: 5132 - DNA, 66 bp, Homo sapiens
caaattattattttctccatgagatgaagccaggagagtgctgttaagtggagagaaaagtgtttg

SEQ ID NO: 5133 - DNA, 70 bp, Homo sapiens
cggaggttccagcagccgcggttcccttttgtggcgcctgccctgggagctggcactgctgtgagccccg

SEQ ID NO: 5134 - DNA, 81 bp, Homo sapiens
ttggataaagggccggtcacgtgctgagcagtgtacttggctctgcttaaggctgctgagcagtggcggcttctcattcaa

SEQ ID NO: 5135 - DNA, 77 bp, Homo sapiens
gctttgtcttcagtattaggccctttcttaggacttccttctttgtatgggggcctgataagccactctgacaaggt

SEQ ID NO: 5136 - DNA, 65 bp, Homo sapiens
gcccacagttgggttagtgactgggagaacgaagtttcccggtcctgaccttttgctccgtgagc

SEQ ID NO: 5137 - DNA, 88 bp, Homo sapiens
tgaaatttggacacgatgaccagatgaacaaagccctcagcatgttttgcatgaatgccacaaaacagggtcactggtctaaaattca

SEQ ID NO: 5138 - DNA, 69 bp, Homo sapiens
cactagattgtgaagactggggtggacctgcttctgaaggtccagtgccctttgtcttaagatttggtg

SEQ ID NO: 5139 - DNA, 75 bp, Homo sapiens
ctcctccatcttggcctcggcagtggcggctgccgggaggatgtgccgccttctggcagggggaagaaggaggag

SEQ ID NO: 5140 - DNA, 77 bp, Homo sapiens
tcttggagtccaggtcagagccctagagaataagagaagcttgctgctggtgagggggtatggccaggattcctgga

SEQ ID NO: 5141 - DNA, 71 bp, Homo sapiens
gtgtttaatgcccaaggttgtttcatatctttgtacttaattgatctagcagtcttgtggcaatgtaatat

SEQ ID NO: 5142 - DNA, 81 bp, Homo sapiens
gtcatttattaagtatattacagggctgcaattcaccagctaccaagttggactctttgctctggaaatttaatgtgtggc

SEQ ID NO: 5143 - DNA, 71 bp, Homo sapiens
gggggtggtgctggattctggggatggcatcacccatgctgtgcccatctatcagggctttgccatgcccc

SEQ ID NO: 5144 - DNA, 79 bp, Homo sapiens
atttgtccttgtaaagatgatttccccctcctgcgttggagggagagtgaatagaagttagcctgcagcaagaacaaat

SEQ ID NO: 5145 - DNA, 83 bp, Homo sapiens
cagatttacactcttggggtatgttagaattccaccaaaactaaggattcaagtgcatttttatctcaaagtggaagaatctg

SEQ ID NO: 5146 - DNA, 66 bp, Homo sapiens
aggtttgtttgtttaggtctctttttatttgttttcagatgactcagatatgaatactgcaggcct

SEQ ID NO: 5147 - DNA, 67 bp, Homo sapiens
gcaccatcaaagccactgtaagcccctccgaactgatagtagtaaatgccccccaagctggtgatgc

SEQ ID NO: 5148 - DNA, 76 bp, Homo sapiens
tctgaaactcattcactcattaggtgttgatttgtttatgaagtcagcgactgatagctgtttgggtctcatcagg

SEQ ID NO: 5149 - DNA, 73 bp, Homo sapiens
gccgttcttatcggtcctcaggatcaaggaccaatcaggtccctcaactggtctggtgagccaataagagggc

SEQ ID NO: 5150 - DNA, 89 bp, Homo sapiens
aaatattcaaaaaagcacagctgctgatgctcatggaaagcttccaaaacacattccattaaaagcacatgctatgcctttgaatattt

SEQ ID NO: 5151 - DNA, 89 bp, Homo sapiens
gggtgcttttcctgttgggagtaaagacagggtcataaacgcctagagtagggtgttttgatctggtgacttctcaggaagtagcatct

SEQ ID NO: 5152 - DNA, 86 bp, Homo sapiens
acaattagaagcatagtacagtacattttctgccttatggttccaagccaaaaaccagagaacttttgtgctttataagcaattgt

SEQ ID NO: 5153 - DNA, 68 bp, Homo sapiens
atgttcagtactcagaaggatccaaggcagattttctttgagtttgctccaggatgggtgctgaatat

SEQ ID NO: 5154 - DNA, 63 bp, Homo sapiens
ggcaccccggacagggcgctcccaaggagtttcctcccggagcccgactgctccggggctgcc

SEQ ID NO: 5155 - DNA, 75 bp, Homo sapiens
aaatgacaactattaatttagtggtagcatgatttgcatagtaatgcaggaaatgtgctgctgattattgcattt

SEQ ID NO: 5156 - DNA, 85 bp, Homo sapiens
tctctccatttagaagctctgattagcagttaccagctggagaactagctggcttgatttcctgtaggtcaactggttggggaga

SEQ ID NO: 5157 - DNA, 70 bp, Homo sapiens
gaagaaggtggaggtggtgtagttgggcctgtttaggaactgattacatctgagcctctggccctttttc

SEQ ID NO: 5158 - DNA, 70 bp, Homo sapiens
ttccatttggctgtgggtggactgactgcaggttttagggctgagttagtatggtgtcagccaaatccag

SEQ ID NO: 5159 - DNA, 75 bp, Homo sapiens
tgggttcctttcacataacaatcaatagtggatgaataagtctcaccacttgaaagtatctgagaaaggaagtca

SEQ ID NO: 5160 - DNA, 72 bp, Homo sapiens
ctcctggcctagagagactgggctctggccaccgcgagcgaccgggtacggagctgagcccagggaagtgcg

SEQ ID NO: 5161 - DNA, 72 bp, Homo sapiens
atggccaccaagtgcaaattctgaattcttatatttttataagaggagtagatgtggttggtaaaaggttat

SEQ ID NO: 5162 - DNA, 79 bp, Homo sapiens
tgccttttcacaaatcacacttttgtttagacaagtgagttcttctcaatcttctttcagagaggtgaatttggaggca

SEQ ID NO: 5163 - DNA, 69 bp, Homo sapiens
tacaactgtcaccttcataaacttcttgagattcaatttcttgaagaaatgaaggtgggcaacgttgtg

SEQ ID NO: 5164 - DNA, 90 bp, Homo sapiens
gttttgtattgtcttttagagttttttcttcccttggacagaaagtgacctgtccagcatcaaaagagctatgacagagaatatttaagc

SEQ ID NO: 5165 - DNA, 79 bp, Homo sapiens
tcaatgtccaccttgggtcctgagatgtcaacgtcagccttaggcaagttgacgtctacttcagggccctctgctttga

SEQ ID NO: 5166 - DNA, 81 bp, Homo sapiens
gtgttaattgttgaccacttatctaggcatccccccaacactgggagcctgagataatgaaagcttgtcagcaattagcat

SEQ ID NO: 5167 - DNA, 78 bp, Homo sapiens
tcaataaaactgattaaaatggtctatttgctagcattttgatgttacttgcagtcagataactttgattactgttga

SEQ ID NO: 5168 - DNA, 64 bp, Homo sapiens
ttggtaacctctaattttaatggaaaataatagagttcatgtctgtaagattagaggttatgga

SEQ ID NO: 5169 - DNA, 71 bp, Homo sapiens
ctgcctgcccagcaggccaggtcttcgtgaactgcagcgacctgcacacggacctggagctgagcagggag

SEQ ID NO: 5170 - DNA, 86 bp, Homo sapiens
atttggattccctttaactggaacagaggcaaggtgttacactaatcacgctttgtcttatgatcaggcaaagcgggtgcctagat

SEQ ID NO: 5171 - DNA, 73 bp, Homo sapiens
caggaaactatcttggctcttagagtgcttaatgtgttcaataagcgcattaattctcttggcaagaatcttg

SEQ ID NO: 5172 - DNA, 74 bp, Homo sapiens
tttagggcctcagcaaattaaaactatgtcctggactgcccaaggccacagaagttgctgtaataggctctgga

SEQ ID NO: 5173 - DNA, 73 bp, Homo sapiens
gtgggccttagtcttgtaaacaatgtttagacacttgtacaaaatactgcagttacagtgattaaaaacccac

SEQ ID NO: 5174 - DNA, 67 bp, Homo sapiens
tactgataatgaaaccatttccaggcaaagaacttaaaacaggtatttagtctggatcgtttcagta

SEQ ID NO: 5175 - DNA, 80 bp, Homo sapiens
atttaggctgtgtctatatgaagcttttttgacttactaaatgaacttttatcttggcattgtatagacatagctttgat

SEQ ID NO: 5176 - DNA, 76 bp, Homo sapiens
agacaattaaggaagatggagtcacagaagtataatatgcttataactctgttccctttaccttgattaattgttt

SEQ ID NO: 5177 - DNA, 84 bp, Homo sapiens
taactagaatttaatcttcccctttggatgttggtggtcttaatattggtccccagcgtcttacaatcaatagatgtttagtta

SEQ ID NO: 5178 - DNA, 75 bp, Homo sapiens
ggctgcatgtgccacttggtcttgttgtgagtatgctgacaccagaaactcagagccagcttgtggcaagcagtt

SEQ ID NO: 5179 - DNA, 90 bp, Homo sapiens
agccctcttttctcactctctgctgttcatggtttatgccattaacttaagtgggcaaaaccagaggggcagcaggttttgacagaggct

SEQ ID NO: 5180 - DNA, 71 bp, Homo sapiens
atagtgtattatcataaaaaccatcaaaatgaaaattactgatggagcttgttttgtgagcatgcaactgt

SEQ ID NO: 5181 - DNA, 72 bp, Homo sapiens
gccctagatatcttgggatggcttgctgtatgagagtcgttgccagcaagctccattcgcgagatctgatgc

SEQ ID NO: 5182 - DNA, 83 bp, Homo sapiens
gtgggatgatgtcacagacattaattgggtggtgtctcaagcagatatctatggtcatctttctctgtgtctgtctctcccac

SEQ ID NO: 5183 - DNA, 83 bp, Homo sapiens
agagcaattgcagaggagaaaatgaccctgtttgctgaaagtaaagacagtttaaggattgctcattcctcttcaactgcttt

SEQ ID NO: 5184 - DNA, 70 bp, Homo sapiens
ttgctagtatgtgcttggtctggctctgagtgccacaatgaaggggtgaggctaggtcaggtggtggcag

SEQ ID NO: 5185 - DNA, 77 bp, Homo sapiens
ctgtgtcccagccttctgtgtatgcaactggccaagtggggtggaggggtggaaagactgaaagggctgggacgtgg

SEQ ID NO: 5186 - DNA, 69 bp, Homo sapiens
gggccttgaacgtccacatctgggacatcaatgtccactttggggtccctgatgtcaacttcggggccc

SEQ ID NO: 5187 - DNA, 75 bp, Homo sapiens
gttctgggagcagcagctacctgtccactgaatgagtaattaattggtgggtggtaaagcaattagccctagagc

SEQ ID NO: 5188 - DNA, 79 bp, Homo sapiens
gttatgctgttctttatgtattgagagaactgtttcttgtaagcatcttcatcttcttgcattaagtagcacgtataat

SEQ ID NO: 5189 - DNA, 90 bp, Homo sapiens
acaaacattgagtcttaggataatctggcagcagacttaagaagaaacttaatattctctgcctctccattccattcccttcttgtttgt

SEQ ID NO: 5190 - DNA, 71 bp, Homo sapiens
caggagattctgtgattaaagaggtggcttaatctagttgtgtctagattccatctccagactgtctcttg

SEQ ID NO: 5191 - DNA, 80 bp, Homo sapiens
tgggcagtgaagtggatatctttgaaggagctaggaagccagactccactgcttacatttccaagatccctcactgcaca

SEQ ID NO: 5192 - DNA, 87 bp, Homo sapiens
agagtcctttttaaagtctgccttgggggaagatgaatcagtttgaccaaatttttcctagaagtgggccagtgtaaaaggtattct

SEQ ID NO: 5193 - DNA, 75 bp, Homo sapiens
tttgggtcattggccctcagagtgaggaccaggacattttgttgttaatttgaaggccagtttcacagacttaaa

SEQ ID NO: 5194 - DNA, 62 bp, Homo sapiens
atcaggagcacattatttaagatactgaagtgctaaattggtcagataagagacgtgctgag

SEQ ID NO: 5195 - DNA, 76 bp, Homo sapiens
tggcttgatattatacagatgcaattttggaatatttacttttagttttccaaatgatctttataaatcaaagtta

SEQ ID NO: 5196 - DNA, 70 bp, Homo sapiens
ttttggaataattttctcttttcatcttttgccatttgaaggaaactgaaaggagaaaatattctcagaa

SEQ ID NO: 5197 - DNA, 88 bp, Homo sapiens
tggcaattttatatttcttttctgttcagattccaagggagtttaggttcagctcatagtcttttggattgtttagagattattgcca

SEQ ID NO: 5198 - DNA, 82 bp, Homo sapiens
ggggatggcagctgcattgcatttataacttgctggcccctggccaggagggccagatgccacagaaagctgatagtcaccc

SEQ ID NO: 5199 - DNA, 77 bp, Homo sapiens
gtgtcagctctaaagatttataaaggttgcactggaacctctttccagttgttatttttataaaggatcagtgacat

SEQ ID NO: 5200 - DNA, 77 bp, Homo sapiens
gctcctggctttattaaatggtatcctgaagggtgcctgacaaaggcgcctaatcacatacagtagtgcaaaggagc

SEQ ID NO: 5201 - DNA, 79 bp, Homo sapiens
aatatcatgaaccatgttttgatacccctttttcacgttgtgccaacggaatagggtgtttgatatttcttcatatgtt

SEQ ID NO: 5202 - DNA, 73 bp, Homo sapiens
gcaggagccctcagcagggagcgttatgcatattctataactctgcttctgaaatctgcaccagggcttctgc

SEQ ID NO: 5203 - DNA, 73 bp, Homo sapiens
gactccatgttaccctgggcagatcctcaagtcctgggagttgggcagctgcaaaggccagtagcagggagtc

SEQ ID NO: 5204 - DNA, 61 bp, Homo sapiens
cccagctctttagggggggtctcctccctcctcccagctcccctcctccttgtgagctggc

SEQ ID NO: 5205 - DNA, 86 bp, Homo sapiens
tcaaagaataaagtagttttctcataagtgattttcttgccctacagaaaattgtctttttcaatgttactataagtattctttga

SEQ ID NO: 5206 - DNA, 77 bp, Homo sapiens
ctgtatttgaaaggttcttaaaaggaaataataggacccaaatgttctaatgttcctttatcatttcagagaaacag

SEQ ID NO: 5207 - DNA, 79 bp, Homo sapiens
cacaggaactatttgctaatgctggttaccatttgaaccattactcaacactggttcccacagaagtctggtcactgtg

SEQ ID NO: 5208 - DNA, 69 bp, Homo sapiens
taaagccaactctcaagaggcaaatttttggagaacacccaaaaatatgggacttgagaatgagttttg

SEQ ID NO: 5209 - DNA, 63 bp, Homo sapiens
aatcacagaggttacatgtgtgcacatgtgtacatgaacgtgcacacacaattttatgtgatt

SEQ ID NO: 5210 - DNA, 72 bp, Homo sapiens
tttcttactaagagcaatgcccctgactcacggatgtttctgtgagccagatttcatggtctgagtcagaaa

SEQ ID NO: 5211 - DNA, 84 bp, Homo sapiens
gagctaatgggagtattcgcctgacagatgagtcccttttgctgggtgtgccagcaaaatcaggcttccaagcccccaaggctc

SEQ ID NO: 5212 - DNA, 86 bp, Homo sapiens
aggaggatctcgaagtgcccactctagtccgctccagtagctccactctggagcgagatggctggtaggtcagtccccatcctcct

SEQ ID NO: 5213 - DNA, 85 bp, Homo sapiens
ttggggttataaagtgttttcaattatatgttcagtgattctgagaatcactcatcggaggttggtgaaactttataaatcttaa

SEQ ID NO: 5214 - DNA, 74 bp, Homo sapiens
catcgagaggaaaattagcatttattttccctgataaacaaaaacagtggaagatttgttggcatcttttggtg

SEQ ID NO: 5215 - DNA, 77 bp, Homo sapiens
agaagatattgtattggtttcctgcccagaaaatgatgcctcatttcctgattatgcagttagctattctttcttct

SEQ ID NO: 5216 - DNA, 72 bp, Homo sapiens
gagggtagggaggagaaagccggcgctcaggccagagctggcgcttctcttggcgtcctcctccttctcctc

SEQ ID NO: 5217 - DNA, 72 bp, Homo sapiens
gacaaaaataagaagccagctgtagtctttatattttgaagaaaatcttaccagctgacatttctttgtgtc

SEQ ID NO: 5218 - DNA, 67 bp, Homo sapiens
taccttgttctttatacattatggaagacactgctcccgataatgtgttaggattgtgacaaaggta

SEQ ID NO: 5219 - DNA, 67 bp, Homo sapiens
gaaaaggtttttctgcgtcatctgggaaatctgccattcccagagaccaggaggcaattactttttc

SEQ ID NO: 5220 - DNA, 73 bp, Homo sapiens
cacaccgcggcctccgcgtccagggcgaaggagccggagctccgctggcgcgtcctgggggagggcgcgggtg

SEQ ID NO: 5221 - DNA, 62 bp, Homo sapiens
ctccggggtggcgggcaccgtggcctgcaccaagggccgcagcgcgcccgccaccccgcggg

SEQ ID NO: 5222 - DNA, 69 bp, Homo sapiens
ggtaaccattaactatgtacatataaagtataaatatgtttatattctgtacatatggtttaggtcacc

SEQ ID NO: 5223 - DNA, 77 bp, Homo sapiens
gctgggaaggttagataattacagagtaaatacagatatgatatatcatgtttttacaagcatcttacattttcagt

SEQ ID NO: 5224 - DNA, 74 bp, Homo sapiens; identical to SEQ ID NO: 1296

SEQ ID NO: 5225 - DNA, 88 bp, Homo sapiens
agtataaatgtgtaccctttagcctgactcttgctcttaagtcatttcttgatttattgtacaagttcctgtttggacacgtgatact

SEQ ID NO: 5226 - DNA, 81 bp, Homo sapiens
tctaggtgttagatgttaatcattagggctgtacagaaacccatgcaggtttttgtcaaagatttcatttgcacacctagg

SEQ ID NO: 5227 - DNA, 78 bp, Homo sapiens
cggatgcgaatccaagtgctattacagcggagatttgtctttatttatcccgctctcatgaatatgaatttgcatttg

SEQ ID NO: 5228 - DNA, 73 bp, Homo sapiens
tcctctgggcttcaatttatttgccaacagccttacttttgaaaaagtcttgctgcgcttgaagtttagaaga

SEQ ID NO: 5229 - DNA, 69 bp, Homo sapiens
gatgaattgtaaattatactctcaccatttggatcctgtgtggagagggaatgtgaaatttacatcatt

SEQ ID NO: 5230 - DNA, 81 bp, Homo sapiens
accagaagtgattctgaggcagggttatggaaagccggtggactggtgggccatggggattatcctctatgaatttctggt

SEQ ID NO: 5231 - DNA, 68 bp, Homo sapiens
ggatttttcagcagccacaaagtttgtattgttgcacaaaggggtgcattgatggcggcgaaaggtct

SEQ ID NO: 5232 - DNA, 80 bp, Homo sapiens
caggagatagtggctaactgatgtaattaactgacatgtcaaaggctattggtttattgcatatgcaactgtctttcctg

SEQ ID NO: 5233 - DNA, 79 bp, Homo sapiens
ttcttatgtactcttttgcagataattagaattatttctcagaatctaaaggtgggtttgcagagtacaccaaaaagaa

SEQ ID NO: 5234 - DNA, 70 bp, Homo sapiens
tgcaatatgtaattataaatatataaatagataagagcctatcaatgtatcttttgtacaatatgttgta

SEQ ID NO: 5235 - DNA, 75 bp, Homo sapiens
aagccccagccaccctggccctgtgctgcccccgctggtggctgcatcccagggtcctgatgggaggaggggctt

SEQ ID NO: 5236 - DNA, 88 bp, Homo sapiens
gagactctgggaaatggacaaggtggggggccccactctttctctcctgcagtcccgtagctggggcctccttccttctcagggtctc

SEQ ID NO: 5237 - DNA, 73 bp, Homo sapiens
gaagctgtcgatgcgcttgcggtaggtgcggttggtgagccgtcccaccatgcccagcccatacggccgcttc

SEQ ID NO: 5238 - DNA, 78 bp, Homo sapiens
ggctccagtcaggctttgctaaaacacaggtgccgagtctctctgggcagttccattttcatgcctgtctttggagcc

SEQ ID NO: 5239 - DNA, 60 bp, Homo sapiens
agcagtaattatgtatttttttaattgcatgcagcaaacttaaaatcctccatttctgcc

SEQ ID NO: 5240 - DNA, 68 bp, Homo sapiens
gaggggagaggaagaagcaaggtgcggggatgaaggtcacagattgcgctttctctgcctctctcttc

SEQ ID NO: 5241 - DNA, 84 bp, Homo sapiens
tatgaccacgggcagtccttttatatttctgttcaatcctcctatttctgaaacatgcatatgaatcacatccctgtggttata

SEQ ID NO: 5242 - DNA, 82 bp, Homo sapiens
tgtatgggctttgataatccaggccatgtaattacctttaagaagcatgcttagggttttttctggagtacaggtccataca

SEQ ID NO: 5243 - DNA, 82 bp, Homo sapiens
ttcccgggggcaggcctagtgctgcagctggcttctgtcagattagctgggcgagatgcagcaggcctctgtcctctgggga

SEQ ID NO: 5244 - DNA, 65 bp, Homo sapiens
gataagtaggctggttgattaggatgaatcccacaggtaatccctaatctactagtctgtttgtt

SEQ ID NO: 5245 - DNA, 64 bp, Homo sapiens
gctggggggctccggcggcgacttgccgggagcccgggaggcgctgccgagcagcagccccagc

SEQ ID NO: 5246 - DNA, 73 bp, Homo sapiens
gtatagatattgcatgtttaaaaattgaacagactatagcatgtttcaatttttaaaaagccatttatttatc

SEQ ID NO: 5247 - DNA, 89 bp, Homo sapiens
taatcttaggtttttgtcatcctaattcctttcaaacaaaaggttttattatttgaaagaacattagaataaaattccttctgagatta

SEQ ID NO: 5248 - DNA, 60 bp, Homo sapiens
atcagagagcagagactgatgaagcaaatgcgtgggccacccattcccttattttctggc

SEQ ID NO: 5249 - DNA, 82 bp, Homo sapiens
tcagctctggggtcagtaaccacaagaagtcatggctcccagaaggctgcctggatctggttagtgaaggttccaggggtga

SEQ ID NO: 5250 - DNA, 72 bp, Homo sapiens
gagtcactgagccccaccaacggccagtcccatgggacgtgcgggccgtttcagtggaagcggctgtgactc

SEQ ID NO: 5251 - DNA, 86 bp, Homo sapiens; identical to SEQ ID NO: 4665

SEQ ID NO: 5252 - DNA, 68 bp, Homo sapiens
cctccctgccctgggcagctttgtctgttgcccaagcaatagtccattaaagcttcctgggctggtgg

SEQ ID NO: 5253 - DNA, 84 bp, Homo sapiens
ggcattccattttgacatgatttacatttatctcacaggtggtttacaagatcagttggaataatatatgtcaaaatatatgct

SEQ ID NO: 5254 - DNA, 84 bp, Homo sapiens
ggtctgggaatccaaggccacgagactccttggtttgtggtccgagatcctgtactaaggagggtctggccagaggaacagacc

SEQ ID NO: 5255 - DNA, 65 bp, Homo sapiens
gtgggttccaggcctgtgaggtgctgggtggttctagctcctccaccaggccctggcggacccac

SEQ ID NO: 5256 - DNA, 74 bp, Homo sapiens
gggcagcagggctggtctgggcacagactgacatcttctagccttgtcttcagcccagagcagaacctctgccc

SEQ ID NO: 5257 - DNA, 89 bp, Homo sapiens
gcctcggcccaggggcgagtatccgttgctgtgtcggagacactagtccccgacaccgagacagccagccctctcccctgcctcgcggc

SEQ ID NO: 5258 - DNA, 81 bp, Homo sapiens
acgcctggcgtactgacggcgtctgaggtggaaggggttgtttaggattccgaacacgcatgcgttctgagacccaggcgt

SEQ ID NO: 5259 - DNA, 70 bp, Homo sapiens
tagctaggcggggaaagaactgttggtgtaacaagatatttaaaagcaaaaatttttccccacctgggta

SEQ ID NO: 5260 - DNA, 79 bp, Homo sapiens
ggtggagggaaggataaagccacttctggcttcagcccccaccaggggaaggaaggagggcacattaactccctccacc

SEQ ID NO: 5261 - DNA, 85 bp, Homo sapiens
ttcactaagattgttttaccatttccatcataaagcccatattttaagggttgtaactggatggtggttttaatttttgtttgaa

SEQ ID NO: 5262 - DNA, 87 bp, Homo sapiens
gtcttgttaataatggcaaatcctttcagtccctctttggtgcaaggtgggctttgattgacaaggtaataaaagtgttaatgagac

SEQ ID NO: 5263 - DNA, 86 bp, Homo sapiens
ggttgactattggtcttgtgccggtctttagctttaattggagtttaccaccaattaactgcactgggctgcattcccaagcaacc

SEQ ID NO: 5264 - DNA, 86 bp, Homo sapiens
gtctgagtttcccaaattaggttattgtgtctatttatgacaggcagttcctgtcatgtaatatgattacatgggctttatcagat

SEQ ID NO: 5265 - DNA, 86 bp, Homo sapiens
ccaagggcccagggtgcggcgggagattttgggtgaagaggtgcgctgaccggccgagcttcctgcgcgtcctgggctcgttgtgg

SEQ ID NO: 5266 - DNA, 78 bp, Homo sapiens
tagtaatggtttctgaagcagttataacataacagtaaccatgctagggataaatgtttcataaagaatccattatta

SEQ ID NO: 5267 - DNA, 88 bp, Homo sapiens
gccctggcagggctggtggaagggatgggatggaggaggactcacttcccagcctctgccttccccttcctccctccctcccctgggc

SEQ ID NO: 5268 - DNA, 73 bp, Homo sapiens
aaagataaatatgttttgtaaaccactttgcttttatcttaaatggggagtcttcggcaaaacatttatcttt

SEQ ID NO: 5269 - DNA, 87 bp, Homo sapiens
ctttgctacagccataaacagacctcccaggatttttccagaggaaacgcagaaatattttggtgtctgctcttggtagtaggaaag

SEQ ID NO: 5270 - DNA, 75 bp, Homo sapiens
agagtgactttgacctattcctcccagactagaaaaattatctggctgccagagagttcttagaggaatcacttt

SEQ ID NO: 5271 - DNA, 81 bp, Homo sapiens
agtaatatttgatgtctgtgatatgtaaagaattatcctaggataaagatattaaactttaagcagatttcagatgttact

SEQ ID NO: 5272 - DNA, 74 bp, Homo sapiens
gcatgcagagagagaatgattaatgtaagcccttctgtaactagccagaggcttaaggaattcttttctgcagc

SEQ ID NO: 5273 - DNA, 90 bp, Homo sapiens
gtgtgattacaattgtacccttaacaggacatgacaatgttttttggcattcaattatgttttgctatgcgtgcatgcatacactcacac

SEQ ID NO: 5274 - DNA, 77 bp, Homo sapiens
caggctcgctggcgcctgggcgcagagagttcttcaatttgccctcggaagtgctgggctgcgtgctagcgggcctg

SEQ ID NO: 5275 - DNA, 80 bp, Homo sapiens
ttgccatcacatccgcctgggaagccacggggccgccaagcccattgtgctgaagtgccccccaggaggggggatggcag

SEQ ID NO: 5276 - DNA, 89 bp, Homo sapiens
aaatgtgtatatttcagaacttctttggagtatttatttagaaatatgggaaaattctgtaaacatgttctggaatatatgtagcattt

SEQ ID NO: 5277 - DNA, 82 bp, Homo sapiens
acctaaacagtcatcacattaccccacatgagcctgactttaacaaaaagttgactcctgggggttaagtgacaacatgggt

SEQ ID NO: 5278 - DNA, 78 bp, Homo sapiens
atttagctccaaatgagaaattctgttttttattgttttaggaaattagtctgtgtactatttctcatggagctttat

SEQ ID NO: 5279 - DNA, 83 bp, Homo sapiens
gagacagtaaacaggataggaatttaaactgggaccattgtatttgctttccttccagtgataaatttccctggttagttctc

SEQ ID NO: 5280 - DNA, 66 bp, Homo sapiens
gcctcctccgagccccgcggagcagcggactcctcccctggaaactcctccggggctgggggaggc

SEQ ID NO: 5281 - DNA, 90 bp, Homo sapiens
tagcagtttgaatgaatactagggagagcctattcagttggtacatttactgaattaggcattgagttccagagagtgcaattgctgcta

SEQ ID NO: 5282 - DNA, 79 bp, Homo sapiens
tcatgctctacttgtcctaggctgatattaacgaaaattaaattttgtgctaatcagccttagcgttcagcatgcatga

SEQ ID NO: 5283 - DNA, 81 bp, Homo sapiens
ttcacatccatgaagtaggaattggggctctgcaccaggtgtttcttcttgtgtttcctcttctcctcttctggagaggga

SEQ ID NO: 5284 - DNA, 71 bp, Homo sapiens
agcggagggggcaggctttggccccatggttggcaattacctctgtgacatccaggcctgtgctctcggct

SEQ ID NO: 5285 - DNA, 81 bp, Homo sapiens
gcaaatgaaaccagggtcatgcctggggtgatagcagttggtgtcatggagctcaggaatcagagccttggttacatgggc

SEQ ID NO: 5286 - DNA, 80 bp, Homo sapiens
atgggttatacaggaaagaaacaggaaatcttgatgaaagcttgggctttacaggatatttgtgtgagcatttagcccat

SEQ ID NO: 5287 - DNA, 84 bp, Homo sapiens
gtagccctcgtagactggggccatgagggcctgggaatatcgggagtgcccaagccccagagcatggcccacttcatgggctgc

SEQ ID NO: 5288 - DNA, 75 bp, Homo sapiens
tgtgatgaggaaatattatatagtttaaaatattagctgcttatatgaatattttaaactttattctttagtaca

SEQ ID NO: 5289 - DNA, 67 bp, Homo sapiens
atttctgcaactgggaaattctgtatattatgttaccatataatgaaggatgccggtaaacagaaat

SEQ ID NO: 5290 - DNA, 65 bp, Homo sapiens
ctagtgctacatagggctcatttttattggaaagatggagtctagctcttggtgactagcattag

SEQ ID NO: 5291 - DNA, 75 bp, Homo sapiens
ggggtgggggaggtgggaggcggggaaatgagctaaattttctggccttttcaaaaggtgccatcctcctaccgc

SEQ ID NO: 5292 - DNA, 79 bp, Homo sapiens
caggaggccaaagggaaaagcgattttccttggtttggaggaaccacaacctgcttttgatgatccattttggtccctg

SEQ ID NO: 5293 - DNA, 71 bp, Homo sapiens
ctcagctggaaagatctgtttttgctggagatcggaagtgcttttccagcaattatttgatctttcctggg

SEQ ID NO: 5294 - DNA, 83 bp, Homo sapiens
ctagacagaaaaggaaatgagatgtgtaggcttgtagtaatacagtatttgtctacatataacttggataaaatctgatttag

SEQ ID NO: 5295 - DNA, 84 bp, Homo sapiens
ggacatttttctcttgctattttatggagtttttatttttgtaagtgacattttgtaattggcagttatggcaagtttgtgtct

SEQ ID NO: 5296 - DNA, 74 bp, Homo sapiens
gttagatctaccctgcctgtactactctagggagtatgctggaggcagagggcaagggaggggtggtattaaac

SEQ ID NO: 5297 - DNA, 72 bp, Homo sapiens
gctcactattccaatattttgtaggtaactggctagctggattggcaattacctacatggataaaagtgagc

SEQ ID NO: 5298 - DNA, 69 bp, Homo sapiens
gagttttccgaattcctgttcttttgactcactcagagctccaaccagtacaggaataatggtaaactc

SEQ ID NO: 5299 - DNA, 76 bp, Homo sapiens
gtatctggccttctgtttaaatgaaattgactcaccaagggtcatgaatgctcatttgttcagagaagaaggatgc

SEQ ID NO: 5300 - DNA, 85 bp, Homo sapiens
gttttccaaggaagtttcttgaatcaagtcttcaaggtgcaaagagtgcctagaaatgaacaataacattattttgttggaaaat

SEQ ID NO: 5301 - DNA, 75 bp, Homo sapiens
ttttttccaagcagcactaggagcaacttggccaagtggccttgggaggaaatgctcagggttgaaaggagggag

SEQ ID NO: 5302 - DNA, 76 bp, Homo sapiens
aggttcttgaaggcaatttgctgtagaataagttttgaagttgagactgtttctgttttattctttcaagtctcct

SEQ ID NO: 5303 - DNA, 78 bp, Homo sapiens
ccttactttcctgctcttgagatccaagtttccagttacaagtggctgagatccttgataagagaggaggcgggaagg

SEQ ID NO: 5304 - DNA, 69 bp, Homo sapiens
tacaggttctatttggagtttggatgtcttcgaaaagcattcagacatgtaagttaagaatactttgta

SEQ ID NO: 5305 - DNA, 77 bp, Homo sapiens
atttcaggattgagacatattgaaatacaacaggaaaatgcttctgttgcctaaaaatggaaatttctttctgaaat

SEQ ID NO: 5306 - DNA, 78 bp, Homo sapiens
cctgacaagtgctttatcatgaaactgatgtttgcaatctcatatccttgttatctttcgtacaaggtacttggcagg

SEQ ID NO: 5307 - DNA, 88 bp, Homo sapiens
caattaagcaaaatcaaataacccatttgaagaagtggagtggtataggccaccaccttttccttcttgttaaggtttgctataattg

SEQ ID NO: 5308 - DNA, 60 bp, Homo sapiens
agaggcagggtataatttggtgatagattcggatttggagaggagctataatcagcctcc

SEQ ID NO: 5309 - DNA, 87 bp, Homo sapiens
agagttagagtagatattgtgcagctgtgtctggctgaagccagaaagtgaaaattaagcagctgacacatatctccttataacttt

SEQ ID NO: 5310 - DNA, 77 bp, Homo sapiens
ctctgagtagctgggactcaactgtctgggacccactgtctgggaactcagccgggtgagccctgcttggctgagag

SEQ ID NO: 5311 - DNA, 86 bp, Homo sapiens
ggtcaaggctgtagaggccccttttcacacagaggaaccagtcaaggactgagattgctctgtgtggtggtggtggtcacctggcc

SEQ ID NO: 5312 - DNA, 67 bp, Homo sapiens
acaaagttgcagatagtaagtaagttatctaaattcttagagaatcaattcactgctgcagccttgt

SEQ ID NO: 5313 - DNA, 71 bp, Homo sapiens
ggtaagaatcaaatgtatgaacttctttgaagccatccaagaaggaatagtacatatattgaaattttact

SEQ ID NO: 5314 - DNA, 80 bp, Homo sapiens
tgatttttagtcctactgatgagctataatctgtctataaagtagtagaggctatagtttatcggtgtgaagcaaagtta

SEQ ID NO: 5315 - DNA, 69 bp, Homo sapiens
taggctttccgtgcatgaatgatgtcattctggtcgggcaggcagatccattcatgcagaggatgttta

SEQ ID NO: 5316 - DNA, 63 bp, Homo sapiens
ctaacacctgtcaattcggtcacagggtttttgacatttttgactgaattgaccaggtgctag

SEQ ID NO: 5317 - DNA, 69 bp, Homo sapiens
tctcataaagttagattttgtacattagtgaggcactgattgcatgaaaataatattggctttatgaga

SEQ ID NO: 5318 - DNA, 82 bp, Homo sapiens
tctgcctcaaggagaaaaggatatctagagagtataattaactttctactttggaacatcttgtttttcctgaaaaagcaga

SEQ ID NO: 5319 - DNA, 88 bp, Homo sapiens
acttgggccagttggagtgcctgttctgtgtcatgtggaggaggtgccagacagagaacaaggggctgctccgaccctgtgccccagt

SEQ ID NO: 5320 - DNA, 84 bp, Homo sapiens
tcttcactatagtgaccttcctaggctctcaggggctccttcagtccccatcctatgagaaactagtgggttgctgcctgatga

SEQ ID NO: 5321 - DNA, 90 bp, Homo sapiens
tagaattgatttctttccatatgtttctagtggtttaatttgattggcagaagaaaatgttgccatttgatataggagaagttattttta

SEQ ID NO: 5322 - DNA, 82 bp, Homo sapiens
aggcttaaaatataaaaattccctcaagagtgctgacagcataccttgcctgttattacagcttgagttttattttgttcct

SEQ ID NO: 5323 - DNA, 88 bp, Homo sapiens
agctgtcacaaatgtagcgaacagtgaaaaagccatgatacaaataaaattacttcatgtgatttttcctgtttccagatgacaagtt

SEQ ID NO: 5324 - DNA, 67 bp, Homo sapiens
gagagggcagtaaatccagctgcataatcatgccctgatatttgtgtagggataattactatctctc

SEQ ID NO: 5325 - DNA, 65 bp, Homo sapiens
ttaatgttggttaatgctttgctaattaaagtatgcatgttaattaaagcagaggctaatgttaa

SEQ ID NO: 5326 - DNA, 71 bp, Homo sapiens
ttgggctcccgggtcctggcctgaggctggagctgcccaggctcgacaggcaggcgacccgggagagccaa

SEQ ID NO: 5327 - DNA, 85 bp, Homo sapiens
tacctttgcacagttagggtaccgcggccgttaaacgcatgtcactgggcaggcggtgcctctaatactgagaatgctagaggtg

SEQ ID NO: 5328 - DNA, 77 bp, Homo sapiens
atggtgggcgtcgtggccttcggcctggtctacgtgctgaaccacgctgaggggctgggagccgcgcacaccaccat

SEQ ID NO: 5329 - DNA, 79 bp, Homo sapiens
ggcaactgttaggggttttagtaacccacatatctttggttccctgggtaaaggcttattgatttttctagcacttgct

SEQ ID NO: 5330 - DNA, 76 bp, Homo sapiens
gaccacttttctgtgtcggcccctgggtcaggttttccatcctgactcatgggtgtcgggaccgctgagattggtt

SEQ ID NO: 5331 - DNA, 81 bp, Homo sapiens
acaggtctgccaagatgctttgggaaacattttaatttaaatgccaagtctatttcaacgaagctccctggtatgacctgt

SEQ ID NO: 5332 - DNA, 72 bp, Homo sapiens
tgttcttcccactctggaagtcttgattttaactgtttaaaatcatatggctgggtcataataggaagaata

SEQ ID NO: 5333 - DNA, 85 bp, Homo sapiens
ggaagtttaaggagtcaagaaggcctgagagaacagagttgttttcgtaggaaatgtgtttctattttagagtcttaaaatttcc

SEQ ID NO: 5334 - DNA, 82 bp, Homo sapiens
tcctgaattatctttacgagatgatttcggctttaacatatgaaaatagcagttgagattgttatctgtgaatttctcagga

SEQ ID NO: 5335 - DNA, 68 bp, Homo sapiens
ccactgagaaattgttgggaaatcagtggaattttgttaaacttcaatgaccagtatactctcagtgg

SEQ ID NO: 5336 - DNA, 78 bp, Homo sapiens
tgcttggccattgtcaagctgtgagtcagccgcactggagagacgggtttaaggctggcactggcatggggccaggca

SEQ ID NO: 5337 - DNA, 87 bp, Homo sapiens
actggctcgagtaagcatcctgcaaacatttggctctttctcttccaggaggaggccaattaaaacacagtctgtctaactgccagt

SEQ ID NO: 5338 - DNA, 61 bp, Homo sapiens
agcagcaggccaggttgcaggttgaggaagtcagaagttaacttgagctgagtttgcagct

SEQ ID NO: 5339 - DNA, 78 bp, Homo sapiens
actataggaaattaatacaagagactggcataatctcacctaataaaaccaggagcaggtgtgtgctagtcctatagt

SEQ ID NO: 5340 - DNA, 90 bp, Homo sapiens
gcctgaaaggccaagagtaagattcttttaaaatcatgcccaagttttaaaggaatataaaactttctctttaaaaatatacctttctgc

SEQ ID NO: 5341 - DNA, 77 bp, Homo sapiens
gtttcttttgggtgaaaacagtctctgatgcagctctattgcaccatttcagcgggtgtttatcatttaaaaggaac

SEQ ID NO: 5342 - DNA, 68 bp, Homo sapiens
gtctattgagttctcagtaagtcatgtgaaaggaagtcctatgataacatttcctgagacttctagac

SEQ ID NO: 5343 - DNA, 74 bp, Homo sapiens
gactgggcagagaaagccaaaagcagatgggccatcattcccagcctctctgctcgccttttttctgccaagtt

SEQ ID NO: 5344 - DNA, 80 bp, Homo sapiens
tccccagaaagagatgttctggcagatgcacaattttggatcatattatccaaaccgttgaattctggaagatttggggg

SEQ ID NO: 5345 - DNA, 60 bp, Homo sapiens
aaattcacaataaagtttcagaaattgttttgtacagtgttgagactttgtgttgaattt

SEQ ID NO: 5346 - DNA, 79 bp, Homo sapiens
gcctgggcccccgtttcctgtctggggaaataaatcagctcagtaattgcccagacacttgaatggagggtcttcgggc

SEQ ID NO: 5347 - DNA, 61 bp, Homo sapiens
aggagcagatgaagcccaagcaggaagcagtgtaggaagaactattcttaactctgttcct

SEQ ID NO: 5348 - DNA, 74 bp, Homo sapiens
gaagcatttatttagaagagttttaaagtacttaggcgcagtccaaagcactcaatttctaagctaaatgcttc

SEQ ID NO: 5349 - DNA, 68 bp, Homo sapiens
agtgatattccacagttttaactggttactgtgaagtccaagcggccagaattgtgaaaatgtccact

SEQ ID NO: 5350 - DNA, 73 bp, Homo sapiens
actttcaaaaattcaactacctagaaatagttacctccagtttagcacatttaggtatttggacatttaaagt

SEQ ID NO: 5351 - DNA, 77 bp, Homo sapiens
gctgacctctgtgaagctggctgtgtagattggctttcaagatcattttgcaaagcccgttttcatgtgctgtcagt

SEQ ID NO: 5352 - DNA, 80 bp, Homo sapiens
tgtgtaccaaatgcccaggtgtttacaactattaataaatgaaaatgtttgtagaacttcatgcctttgggcaggacata

SEQ ID NO: 5353 - DNA, 83 bp, Homo sapiens
ttcagaatctagaatctcatttaataggattgatttaagaacacattctaaccaatttttgtatgaatggatagtattctgaa

SEQ ID NO: 5354 - DNA, 76 bp, Homo sapiens
tatacaatttagtttgattacagtataggtcagcttggcagatgagctgcttgaaatagatgatcaagattgtatg

SEQ ID NO: 5355 - DNA, 66 bp, Homo sapiens
gagctgacccagggtgggcgtttggaaggactcagcctccgtcctgcctggtgctgggatcagctt

SEQ ID NO: 5356 - DNA, 63 bp, Homo sapiens
tataagcctgtatgtttacttgaatttagatattcctgacatgtaaattatgcagagtttgtg

SEQ ID NO: 5357 - DNA, 76 bp, Homo sapiens
gtctccagggagagcccgggccacccggacagatgggaccagaaggtcctggaggccagcagggctcgccggggac

SEQ ID NO: 5358 - DNA, 60 bp, Homo sapiens
agaggaataataaaaattgcaaaaataaaaaaaaacttttgcaaatttttttatttttcc

SEQ ID NO: 5359 - DNA, 65 bp, Homo sapiens
tagcataactgttagcaaacaatggataattttctttcattgcttattatgttaatattatgtta

SEQ ID NO: 5360 - DNA, 79 bp, Homo sapiens
tgaggtacttgatatgcggtgtgtttcttctctgtgaatcaattcagctgagaagcaaagaactgcacttcagacttca

SEQ ID NO: 5361 - DNA, 69 bp, Homo sapiens
agggaggagacgctgattttcattgtcttggcccaattccaagtttgataattaggagtcctcctccct

SEQ ID NO: 5362 - DNA, 84 bp, Homo sapiens
cttgatacttggctttacggtctgagtgtaccctaaacctatcaggctagggttgtacactttagccaagaagcaggcatcagg

SEQ ID NO: 5363 - DNA, 76 bp, Homo sapiens
cttccaggatattctaaaagccccgaggcgggagttcatactctgtatatttggcatttggaatctcatatggaag

SEQ ID NO: 5364 - DNA, 70 bp, Homo sapiens
gagattagaaagagtgtgcttgatttgttctgcagctcctgttataaaaggttttactgtttctggtctc

SEQ ID NO: 5365 - DNA, 90 bp, Homo sapiens
ggcccctgacctcagcactggctggttgggcactgcgcagcagttctgacactgctcccgcaaggccctttgctgcctgcaacaggggcc

SEQ ID NO: 5366 - DNA, 79 bp, Homo sapiens
gtgctaatcatagaaaatcagactatggcttgaaatgactagaaaaacatttcaaattaggctgctttatgatttgcat

SEQ ID NO: 5367 - DNA, 70 bp, Homo sapiens
ggtgagtgtggggctgccggtggcgggtgtacatcagacgcattttatctactggcggcacaatactccc

SEQ ID NO: 5368 - DNA, 83 bp, Homo sapiens
atggtccccctgctgatagctcaaccatgcaagtgccataggaaacagactttggcatttgagctgctcacagtctgggtcat

SEQ ID NO: 5369 - DNA, 70 bp, Homo sapiens
ccagtcagagtggggaccatgtgtcagtctctcaaagaagatatatggtcttgtgtaccattaggattgg

SEQ ID NO: 5370 - DNA, 74 bp, Homo sapiens
ttatggagcgacaatctggctggatggaccaacaaagttggaggcttttgatgccagaaagattgtttttataa

SEQ ID NO: 5371 - DNA, 70 bp, Homo sapiens
ggaggagagagaggctcagagtgggttgcagaggaactggtgaataaattcttgagccttcttcttctct

SEQ ID NO: 5372 - DNA, 82 bp, Homo sapiens
ttctttctgaaagtcttctaaataagttgattgattggacctcttcttcagatgtcaatttaaatgaaagttctagaaagga

SEQ ID NO: 5373 - DNA, 81 bp, Homo sapiens
atcatgatttaattgggttatagtattagccaagtgagtatttatctagttgggttaagactatgattcatgatcagagat

SEQ ID NO: 5374 - DNA, 65 bp, Homo sapiens
catccatcactgtttcctttaattgaggttaatttctttcaacttgggggaaggtgggagggatg

SEQ ID NO: 5375 - DNA, 85 bp, Homo sapiens
atccaatttcctttcgctgactaatgtatctagtcaaggatgctgctacctttaaatttggttagttggagggaatttattggat

SEQ ID NO: 5376 - DNA, 74 bp, Homo sapiens
attctgccattacaagccagagacattataaattcattttatatatgtgtttccttccttgttcccagcagaat

SEQ ID NO: 5377 - DNA, 79 bp, Homo sapiens
agtctccgtcctactgactttcagtgtaaactcagtacctgacccattacccctgaacctgtctgagaattcggaggct

SEQ ID NO: 5378 - DNA, 60 bp, Homo sapiens
agaagtaaaacaatgctttgatttcaaatattaaattaacttaggcattgctctcccact

SEQ ID NO: 5379 - DNA, 87 bp, Homo sapiens
gagtaattttttaaggtggccggaggcttattttatcaggattagctaataaatcaggctccatcaccgaagaaggagtttaaactc

SEQ ID NO: 5380 - DNA, 60 bp, Homo sapiens
atatacacatccgtatctatacatgcacttatgcacatatacacatacctgtgtgtatat

SEQ ID NO: 5381 - DNA, 73 bp, Homo sapiens
ttctgtgtttctctagccgtttcctctccctcgccggcctcggcggagattccaggccctatagaaaccagga

SEQ ID NO: 5382 - DNA, 82 bp, Homo sapiens
tccacccatgcatttgcctgagaaaaataactgattttttaagttataaaaatatgctttctcttccatctgagtgggtgga

SEQ ID NO: 5383 - DNA, 60 bp, Homo sapiens
ggcaggaaggaaatgaatgtgaccttgcagagtactgcgacgggaattcaagttcctgcc

SEQ ID NO: 5384 - DNA, 67 bp, Homo sapiens
agagaaacacaagagcaaggtgctgaggcaaaaaacacctgaggtagctttttctgtgtgtttttct

SEQ ID NO: 5385 - DNA, 60 bp, Homo sapiens
agcaacccgccattgtttactgctgaaactgtatggctggagagcattctctgtgttctc

SEQ ID NO: 5386 - DNA, 68 bp, Homo sapiens
gcgggaaggcgcgccctagcctgcgggccagtggagtggccattggccggctgagggcggcctccagc

SEQ ID NO: 5387 - DNA, 83 bp, Homo sapiens
ggagctgtcgatgagctggcactgggacttctggtcctgcagcacggtggtgatgtgggaccagttgtgctgggccacggccc

SEQ ID NO: 5388 - DNA, 61 bp, Homo sapiens
acacacacatatacatatgtatatatgtgagagatacacaaccgtgtgtgtgtgtgtgtgt

SEQ ID NO: 5389 - DNA, 76 bp, Homo sapiens
ttattttttggaagagaacccctttgctgtctcctgaggcatgtttagaaaggggtgtggacaggccaaggaatga

SEQ ID NO: 5390 - DNA, 75 bp, Homo sapiens
ggacaccgtgaaagggcagtcagtttggcatttgtgacgagcaaagcagagaattcacctcagtttgtggtgtcc

SEQ ID NO: 5391 - DNA, 76 bp, Homo sapiens
gatggtagttcttttaatagccatgatgtcattgagataaaacttagtgggatagatgttattaatggtcaccatt

SEQ ID NO: 5392 - DNA, 73 bp, Homo sapiens
cttaggggagatatttgctattttctccactgatttgaagtaggtcagattgagagctgaatgcttccctaag

SEQ ID NO: 5393 - DNA, 88 bp, Homo sapiens
cagtgaagatgctgagctgtccatttatagcatcatttgttctttcacagctgcttatagaaagtgcagttctcagcttcagacactg

SEQ ID NO: 5394 - DNA, 84 bp, Homo sapiens
aggtgaggagcaggatggggcctctgggggtgtgactgctggggacatagccacaggggattaccttcttctcactcctcacct

SEQ ID NO: 5395 - DNA, 76 bp, Homo sapiens
gttaatggctcccagggagtgggtttaagagggcttagcgcatatgccttcgtctactctactggctgtaaataac

SEQ ID NO: 5396 - DNA, 79 bp, Homo sapiens
cctatttatatgatgttgaggagtttgttaaaattagctgatattttaggatccttttgacattttatatgattatagg

SEQ ID NO: 5397 - DNA, 78 bp, Homo sapiens
tcccagggtgatcctcttctgcttcaggagcttggcaaattgctcgagttctttctgcagagctttgatgtcctggga

SEQ ID NO: 5398 - DNA, 90 bp, Homo sapiens
tgctccttgaggtcagccaggaaatggaaagcaacatcaggacaacaaatgtcacctggtgcagcccagtgtcaaactgcttcaggggca

SEQ ID NO: 5399 - DNA, 71 bp, Homo sapiens
tgcacaggatggtaaattggattggtggatccaccatatcatgggatttaaatttatcataaccatgtgta

SEQ ID NO: 5400 - DNA, 90 bp, Homo sapiens
gtgggcactgatttcccatgaagttcatctcttgttggtactgccagttcccacaatcctagcattctctgggcatcagtcagtgtctac

SEQ ID NO: 5401 - DNA, 68 bp, Homo sapiens
cagcttgccatcttatctgtctgtatgtttattgcataaagaatttacagcagataaagatgtagttg

SEQ ID NO: 5402 - DNA, 77 bp, Homo sapiens
gccagatacaagaaatgggcccctcgccccggccccgggtgacgggctgggggagggggctcgtgtctcagtgctgc

SEQ ID NO: 5403 - DNA, 81 bp, Homo sapiens
ccccgggatttgtaggggcaccctcccctcccacctccctgctccccagcactggagaccctgcccaatcagatcctgggg

SEQ ID NO: 5404 - DNA, 71 bp, Homo sapiens
gtcttctctccctccttccctttattggcactgcccggaaccaggcagccagcaggggatgggatcaggat

SEQ ID NO: 5405 - DNA, 75 bp, Homo sapiens
ttgtgacagtgtttgctggatgccgtgtcctttatacctcccctgaaatgagtagtttagtttgcactgttacaa

SEQ ID NO: 5406 - DNA, 67 bp, Homo sapiens
ggcacttctgttttgttcttggaggcttggcttctcattgccattttctaaagcagtagagagtgcc

SEQ ID NO: 5407 - DNA, 78 bp, Homo sapiens
taacatatttattatatagcattttatctccattcatttagaatttgggaaaattggccatatttataatgtatgttg

SEQ ID NO: 5408 - DNA, 63 bp, Homo sapiens
caggatatggtttttaatgaggcttctagaagctttagaaacttctttaatgattttgttttg

SEQ ID NO: 5409 - DNA, 80 bp, Homo sapiens
ggcagatatacatagagaaagatgtgtgataagaatgtggaaaatgaatgaatgggtggcatgtatctgtgtgtattgtc

SEQ ID NO: 5410 - DNA, 79 bp, Homo sapiens
ctgtggatacgcagacagtagaaacagtcttaaagatatttctctagagtctgtttaagttcgtgttgtgcatttatag

SEQ ID NO: 5411 - DNA, 75 bp, Homo sapiens
cccaactggtttatgtcagcattttggaaagaatatcagtctttaaagcggtgttagagatataaaccctctggg

SEQ ID NO: 5412 - DNA, 71 bp, Homo sapiens
agaggcacagaagtaaccgcagatgccacagcagaagtgtgctgatggcaccatctgctttctgcaattct

SEQ ID NO: 5413 - DNA, 77 bp, Homo sapiens
gaagctgttctatttgagagttatatttgaatttgcacagggaattaaattttagctttcagaagctgaaaggtttt

SEQ ID NO: 5414 - DNA, 74 bp, Homo sapiens
tcctgttttccttacagaactcagccagttcctggagaaaccaggcccagcttcatttggaggatttgacagga

SEQ ID NO: 5415 - DNA, 67 bp, Homo sapiens
gtcaccaagaagttgacaggcaggtgactgttacacacaagctcattgtctgtccttttcacgtggc

SEQ ID NO: 5416 - DNA, 60 bp, Homo sapiens
agcagcgggacattatcaggatggatggagggaggtgagcctggtaatatgatccctgct

SEQ ID NO: 5417 - DNA, 67 bp, Homo sapiens
ctccctggccatatggctcagggcctccctgggtgcaccggggatggcatttgggaagctcagggag

SEQ ID NO: 5418 - DNA, 71 bp, Homo sapiens
aatgatatactgtgatgatgaaaacatttattgacatcaataaactatgtatcctcattcagattctcatt

SEQ ID NO: 5419 - DNA, 86 bp, Homo sapiens
ggggccgccaggaggtacaggcgctccttggtctccaggaagaaggcactggtgtcccgggggctgctggcctctccgccggcctc

SEQ ID NO: 5420 - DNA, 84 bp, Homo sapiens
tctccagataagaagtggcttggaactcccattgaggagatgagaagaatgcctcagtgtgggatccggctgcctctcttgaga

SEQ ID NO: 5421 - DNA, 66 bp, Homo sapiens
accaaatgctgcatcttcgggcattatatgaacctcaataatgacctcagaagggctcattatggt

SEQ ID NO: 5422 - DNA, 84 bp, Homo sapiens
catgccgttttagttcacgaaggccaagctaatgctgggcactactgggcatatatttttgatcatcgtgaaagcagatggatg

SEQ ID NO: 5423 - DNA, 68 bp, Homo sapiens
agtgacaaatcatccaaagctgaagataataaaaagttatatttgcctttggaatgtattttggtact

SEQ ID NO: 5424 - DNA, 77 bp, Homo sapiens
agccgggactctgagtaatctaaaataagagctggcaacagaagcttgccagctgttgcacatttaccagcccagtt

SEQ ID NO: 5425 - DNA, 63 bp, Homo sapiens
tccggtaggccaaggtgttttcctggcatcgagcctgggaatggacagtcattggcttgcgga

SEQ ID NO: 5426 - DNA, 80 bp, Homo sapiens
tggcactgtttccatttccacatccaatattatgaaataaagctataataaactggtattaagaatggggtataatgcca

SEQ ID NO: 5427 - DNA, 71 bp, Homo sapiens
gctggtggttcagaagtcagggtaaatgacatcatgggtatttttgttgccctgatttttaacatcctagt

SEQ ID NO: 5428 - DNA, 69 bp, Homo sapiens
tttggcttcaggatggagggaagcacagaaatttcaagatttctgactgcttgatcctcctgtgtgaaa

SEQ ID NO: 5429 - DNA, 62 bp, Homo sapiens
agctgctccgcgggctgcgggcgggcggggcagcctctcctccgcggcccgagggcgccgcc

SEQ ID NO: 5430 - DNA, 82 bp, Homo sapiens; identical to SEQ ID NO: 4646

SEQ ID NO: 5431 - DNA, 75 bp, Homo sapiens
taattttatttcttttcccctccaagccccagtgccccatctggcctttagtggagggaaacagggctaagatta

SEQ ID NO: 5432 - DNA, 69 bp, Homo sapiens
ttcttgtactatgtcactttgtggggttggtgcttgccacacttcttacagtctgacaggttttaggaa

SEQ ID NO: 5433 - DNA, 89 bp, Homo sapiens
gggggcagggatgaggcacacacaccagcacagagccagtggcctgtcacgttgcaaaggctggtgtggggcttgctgatcttgttccc

SEQ ID NO: 5434 - DNA, 86 bp, Homo sapiens
gatttgggagcgtccgcaattgataaaggaaagaaatattattcaaacgtcctttaaaaattgtacagggaaaatgatccgaaatt

SEQ ID NO: 5435 - DNA, 77 bp, Homo sapiens
agtggagtttctgcaaaggtctctgccagccactacagtcctggcatacatccctcccaatctgcaaaaactctact

SEQ ID NO: 5436 - DNA, 73 bp, Homo sapiens
gtagacaggaaatctgtcttgtaaaaggatgaatgaccggtcatccttctttataaccagacctcatgactgc

SEQ ID NO: 5437 - DNA, 75 bp, Homo sapiens
gtattggggaattatgtaaattctttatatgaaactatctagttcataaatcatagatttcatattactcagtgc

SEQ ID NO: 5438 - DNA, 83 bp, Homo sapiens
tttgttttattttctgggcagtggtagtgttcggaatttattattccaacggtacttagaggtaactagaaaattgtggcaaa

SEQ ID NO: 5439 - DNA, 68 bp, Homo sapiens
gggaggccagcaagggaggatggctgcaggttgagttaatcaatatgtaatattttctatggtctcct

SEQ ID NO: 5440 - DNA, 79 bp, Homo sapiens
tgattagggctctgcattatttccagcataatttggttttccctagattagtttatggactgacactggcctctagtca

SEQ ID NO: 5441 - DNA, 84 bp, Homo sapiens
tctgagcaactgaaacaaaatcaatcctaggggagaatgcataactctattgatgttctcacccttgttgatacattgtttaga

SEQ ID NO: 5442 - DNA, 75 bp, Homo sapiens
gctccttaatccggatctccagctcgcagagctcctccgggtgggaggcagaggcgagcctgggggtcgaggggc

SEQ ID NO: 5443 - DNA, 86 bp, Homo sapiens
gcatcctgatgccaaatgaaagatttaagcaagttccctatttttagggctttgtatcttggtagctgtataatgaatcaggatgt

SEQ ID NO: 5444 - DNA, 79 bp, Homo sapiens
tttagctatgtattctccttctattaagttattgcaacataaaggtgatttattaagatgagaagcagacattgctaaa

SEQ ID NO: 5445 - DNA, 62 bp, Homo sapiens
agcaataattaaatgtgtctttatagatattgcaggaatgtatacatattgtgattaatgct

SEQ ID NO: 5446 - DNA, 60 bp, Homo sapiens
agcagcatgtgagctattctctcccaagcacagagccgaaaggatggctaatctgcttct

SEQ ID NO: 5447 - DNA, 84 bp, Homo sapiens
agtcctgttctaagacctttatgacttgccatacagtatatttgtcaagcaagggtaacgttatgattgtgaagaacaggcact

SEQ ID NO: 5448 - DNA, 87 bp, Homo sapiens
gaaagcatatgttcccgatgattgctcattctctttccaataatatctttgcaggacaaagaggaatggggaagggaacatactttt

SEQ ID NO: 5449 - DNA, 74 bp, Homo sapiens
gcaattgtgatagaggccagactgaggactaggatgacagcatcttccattagagctgtactcactacagttgt

SEQ ID NO: 5450 - DNA, 67 bp, Homo sapiens
gacgaaccttggccgcagtccttgcgaactgttcgcaaaacagtgcgggctgcggtgggtcagcgtc

SEQ ID NO: 5451 - DNA, 79 bp, Homo sapiens
attacttcatgtctcttcaaaagcctttcaaagaaacaagtcaagcttgatttgtgtttttgagatagaggaaagtagt

SEQ ID NO: 5452 - DNA, 71 bp, Homo sapiens
tttacggttaatattttccctggaacattgtcaagcttttgacagtgcctgagtgtatgccgaactgtgaa

SEQ ID NO: 5453 - DNA, 75 bp, Homo sapiens
gaggagctttcctatcatttcagccattatttgctttatgtgcaggtgaacaaggtcagatgcatggtgctcttc

SEQ ID NO: 5454 - DNA, 72 bp, Homo sapiens
ggggagggatagggaatggcttctcaggattattacagtgatttgtgactctgttattccactgtctccctt

SEQ ID NO: 5455 - DNA, 75 bp, Homo sapiens
gctggtatttgtgttttccagggactttgcagaggtgctaattagctcccttgcaaagctctataatcaaacagt

SEQ ID NO: 5456 - DNA, 86 bp, Homo sapiens
ccagtgcctgaattcaaggcccttgtgttaatatttactgtattgtagtagtgagatttccacgaggcactctgggtttagactgg

SEQ ID NO: 5457 - DNA, 75 bp, Homo sapiens
ggtcatggctgactgagcagatgactgagatcagagagatcatacctcatttgctcactaagtcctgccaagagc

SEQ ID NO: 5458 - DNA, 82 bp, Homo sapiens
ttcccattgccctggtgtggggggtagccaaggtcactgctcctgtcattgctgcctctccctcccctgctggcaatgggga

SEQ ID NO: 5459 - DNA, 77 bp, Homo sapiens
tctcagatgtaaaataaacccacatgcagttcttgatttacacggattgtcatgtcgtcattattttgcctttgaga

SEQ ID NO: 5460 - DNA, 83 bp, Homo sapiens
ttcccctcccctcccccgttcaatcagcggcggtggcttccgtcttaaaggggccgcggcggccgggggaggaggaggtggga

SEQ ID NO: 5461 - DNA, 82 bp, Homo sapiens
ctcaggcctgggatttatggaagaacttgagaatccctttgcggatctccttggttttcacactgtagatgatagggttgag

SEQ ID NO: 5462 - DNA, 84 bp, Homo sapiens
ccctgtccacctcacctccctcccctctcatccatcgtcagccatggctcaccgggacagggcaggggaggtgggagggcaggg

SEQ ID NO: 5463 - DNA, 88 bp, Homo sapiens
ctgtacagtttaagaacaaatcatatgtagccttacttctttctttaaaaggagtgagttgtgtataaggggtttaaatgctttatag

SEQ ID NO: 5464 - DNA, 77 bp, Homo sapiens
tctcttgggttgtgggcagatggacaggcaaggagtgggaagggcctagcctgtctatcttccaatgcactgagggg

SEQ ID NO: 5465 - DNA, 82 bp, Homo sapiens
gggggtagggctgaggtgattggggtgggggaggggaggcccggcccctctgaccccgctccgtctcccactttcctccccc

SEQ ID NO: 5466 - DNA, 88 bp, Homo sapiens
ctcgagcctaaaggcaactgctgatttacaagcattctgtaatatatgcagtcttggctgatgcttttgttgttgatttaggctggag

SEQ ID NO: 5467 - DNA, 76 bp, Homo sapiens
aaacagctaaaagatacataggttattttgctttttaaaattttagcaaactattctgtgaatcttttgtgtgttt

SEQ ID NO: 5468 - DNA, 89 bp, Homo sapiens
agtacagaaatctcaagggtcaaagatttgaaaatgttttcagcacgaaaatcgtagaggcaaatgtttgatgtacagatgtgtgtact

SEQ ID NO: 5469 - DNA, 71 bp, Homo sapiens
ttaaaaattaaatgctagagattttgtttgttgtgaaagtcatacaggatccgctggctttatatttttga

SEQ ID NO: 5470 - DNA, 86 bp, Homo sapiens
ccaaacgaccatctgccgctttgagggtctgcagcttagcttcaagaacatgtgtaagctgcggcccttgctgcagaagtgggtgg

SEQ ID NO: 5471 - DNA, 69 bp, Homo sapiens
tcctcagtgttgtaatagcctctctgtgtgtttacttgagaacaaatgctgttataatttctttgggga

SEQ ID NO: 5472 - DNA, 84 bp, Homo sapiens
gggctggggctggcaatggagcccctctcctagcctcctccatggggactggggctccaggggccccatcctgctcagcctccc

SEQ ID NO: 5473 - DNA, 77 bp, Homo sapiens
tgattttctcttccccgaaaagcctattaaaaggaaacatcttttctaatgctttccagggggcctccaggaaatca

SEQ ID NO: 5474 - DNA, 70 bp, Homo sapiens
aatgtcttcccatctcacgccgtgaggagctctttggtgtggctcatggctggatgtgaggaaagatatt

SEQ ID NO: 5475 - DNA, 79 bp, Homo sapiens
gttcatcacacagctgcatgattacaggagtcttgttctagattctaacagatgctgtaacaaacagttttgtgagggc

SEQ ID NO: 5476 - DNA, 82 bp, Homo sapiens
gccagctgttcccagatgtgggccgcggcctttcctctttctggaggaatgacaggcctcccgcagaggaggagcgggtggt

SEQ ID NO: 5477 - DNA, 82 bp, Homo sapiens
aacctcacattttgtgtaattatagttggtacatatgaaacatactgtgttttgttcaacttgtggttgcaaatgtttggtt

SEQ ID NO: 5478 - DNA, 61 bp, Homo sapiens
tacagcaagttattatttgccattgacaccacagtgtgaattagttgattagcttgctgga

SEQ ID NO: 5479 - DNA, 87 bp, Homo sapiens
tgcagggcctttaaacttggggaagcacatataataatgttgttctatattgttatttggtatatcaagccatctaaaagcactgca

SEQ ID NO: 5480 - DNA, 81 bp, Homo sapiens
tttttgctacgctcattatctttgtatttaaatgttttaggcaacctaagaacaaatgtaaaagtaaagatgcagtaaaag

SEQ ID NO: 5481 - DNA, 77 bp, Homo sapiens
tctgatgtgtaagttgctagctgtgatcttcatatcactaaaacgaacaagataccattctaacaactttacacaga

SEQ ID NO: 5482 - DNA, 69 bp, Homo sapiens
agaaagaggaaagagaagagatcgctcaggggtgagaccatgcccttcatcttttcttttccctaatct

SEQ ID NO: 5483 - DNA, 63 bp, Homo sapiens
gctgtctatcgtgatgttggatggtgcttgtgggcccctggtccagtcagtatgagagatggc

SEQ ID NO: 5484 - DNA, 60 bp, Homo sapiens
aaacacaggaaaatatgtgtggcctcataataaagttaaataaatattatttctgagttc

SEQ ID NO: 5485 - DNA, 68 bp, Homo sapiens
ctgggggattgggggctggatggctgggaaggacttcccaggcctgcagtggtctctcctttcctcag

SEQ ID NO: 5486 - DNA, 63 bp, Homo sapiens
gactccaacttcagacagagaactatttgaagcagctgccagatgttgtgtctgaattgggtt

SEQ ID NO: 5487 - DNA, 75 bp, Homo sapiens
ttctgtgttcctggtgagccattttttcctgtcgtggaattcgatttgagccagagtggctgccaggaacgagag

SEQ ID NO: 5488 - DNA, 68 bp, Homo sapiens
tttaatactgtaatacatttcaatataaaataagaggtgaatgttaaaatactgtattacatgttgaa

SEQ ID NO: 5489 - DNA, 72 bp, Homo sapiens
ggaagaagcgtgcggtttggatttttaaaacgccattctttatttagattccaacatcctcgcgtttcttct

SEQ ID NO: 5490 - DNA, 75 bp, Homo sapiens; identical to SEQ ID NO: 4262

SEQ ID NO: 5491 - DNA, 70 bp, Homo sapiens
gcagatttagctagtttccaaatggaaagatgagctgcagagctttatactgtttggaggttaaatttgc

SEQ ID NO: 5492 - DNA, 79 bp, Homo sapiens
gccagctgtaacaattcttgggcatcctcaagccagtcattggctgcttgaaatacctgataatacctttgacactggc

SEQ ID NO: 5493 - DNA, 64 bp, Homo sapiens
agctctgtttattttgtgtgatttcatgcacggatgaaaaactcaacacacaataacagaagtt

SEQ ID NO: 5494 - DNA, 79 bp, Homo sapiens
ggtttcatctgtgtctggtagcagtgtctgtctgtgtttttcattcagatcttgctatccacacaaacatcatgcggcc

SEQ ID NO: 5495 - DNA, 76 bp, Homo sapiens
ggatttattttaaagtgttcttccttcttccaatgacagttttcacagatggaagcacccttccaagataaactcc

SEQ ID NO: 5496 - DNA, 78 bp, Homo sapiens
ccctcttcccagcactaccaggcagggtccccattcaagaaagggctgcggctgggcctggggtgaggtgggataggg

SEQ ID NO: 5497 - DNA, 71 bp, Homo sapiens
gtgctcctggcccatcccagcaggcctcaggctggcgtctggggagtgtgttgggtcggccagtccagcac

SEQ ID NO: 5498 - DNA, 75 bp, Homo sapiens
agccctgcgcaatctcattgcagatttgcaagttttctctctttctcatgcgatgcagatattctgccatgggct

SEQ ID NO: 5499 - DNA, 74 bp, Homo sapiens
gtggtttattaattgagacagagaggcagatgcgttgcttagcgttagatctttctgtctgtccagtgaaccac

SEQ ID NO: 5500 - DNA, 62 bp, Homo sapiens
agcagcacccaaagctttttctcacaccatggcttaaagcgaggacccttcctggggctggc

SEQ ID NO: 5501 - DNA, 90 bp, Homo sapiens
gaagataataacttggacattaggctttgagggtgatgaattaatttttaatcatagaactatcaagaatatgagagaattattatcttc

SEQ ID NO: 5502 - DNA, 69 bp, Homo sapiens
gttatgtttatatgcagaaatatttatggatactacaccaagtgtttatttaatgttgataaatatgac

SEQ ID NO: 5503 - DNA, 88 bp, Homo sapiens
ctttaagatttttgagaagctgccttttcattaatatatccatatttgccttttttgtatggatgaccagtttccaaatgtcagaaag

SEQ ID NO: 5504 - DNA, 74 bp, Homo sapiens
ttcctgggcctgctctctggctcccagtgagggtccccgccccacgggagataagatagagctggtgtcaggga

SEQ ID NO: 5505 - DNA, 80 bp, Homo sapiens
gactaaataggaaccctgtgcgggagccctcttaccccacaggtaggagcaatcaactcaagatggtgccctaattagtc

SEQ ID NO: 5506 - DNA, 79 bp, Homo sapiens
gccctaactatcctgtgtgagaatgggaatttcaagtcccatcttgtaaattgtatatgttgtcatgcagggtttgggc

SEQ ID NO: 5507 - DNA, 76 bp, Homo sapiens
ctcccaggcttcctgccattgacaaggccacagtccttttcctgtggctttgccagaggctggctgtacctgggag

SEQ ID NO: 5508 - DNA, 70 bp, Homo sapiens
cactgtatgtagaatagctgacaactgtgaagttgggataacaatgaatttgtcatgcattcttacagtg

SEQ ID NO: 5509 - DNA, 71 bp, Homo sapiens
cctccaacgtcatcattgtctgcttctcagttcctggtgggattgtgagcagacaatggggaactggcagg

SEQ ID NO: 5510 - DNA, 71 bp, Homo sapiens
tgcattttatgagacagtatttttatttacatgattcttttaccccatgagaaacttctccataaaatgca

SEQ ID NO: 5511 - DNA, 77 bp, Homo sapiens
ggggtctgaaagatgctagcccagcaaatttttctgcatacagaaaaattcaaggagctgtcattttgagaattacc

SEQ ID NO: 5512 - DNA, 69 bp, Homo sapiens
gctttgctcagaaaggtcagcatgagagacaagaacaaagagatctttcaagctggcctctggcagggc

SEQ ID NO: 5513 - DNA, 79 bp, Homo sapiens
gaggaggcccccgagctggctgttctaacttagaaggaagagaagactggatgggcctgcttgggatctaggcctcttc

SEQ ID NO: 5514 - DNA, 61 bp, Homo sapiens
gggcagcagggtctgggagcggggtggtgtcccacctcgggacctacccagccctctgccc

SEQ ID NO: 5515 - DNA, 82 bp, Homo sapiens
attttctgttttgcttattcaaatgtagaatggctgcagaattaactattgcagcaattatctgattagcaatttagaaaat

SEQ ID NO: 5516 - DNA, 83 bp, Homo sapiens
taagaaaatcattcagtaaacatgagacaagtttaggaaaaactaataaaataaacctgtcttaaacttgaatggtttcctta

SEQ ID NO: 5517 - DNA, 74 bp, Homo sapiens
tgcctactttggaggagtgggaggccctgtgccagcagaaagctgcagaggcagctcccccaacccaggaggca

SEQ ID NO: 5518 - DNA, 78 bp, Homo sapiens
aaatatttatgtaggttgcttagaatgcccccattgtacacaatgctaaaattcttaacaacacttgaaagaatattt

SEQ ID NO: 5519 - DNA, 74 bp, Homo sapiens
gcagcttccagcttgtgtagctcaatctggccatcacctgtggtggccagtgaattggcactcagctcagctgc

SEQ ID NO: 5520 - DNA, 72 bp, Homo sapiens
ttaggacattgcttgatgattcatagcaaggtcctttagacattaatgtgagttatctaagtacagtcctaa

SEQ ID NO: 5521 - DNA, 79 bp, Homo sapiens
cattctacttggttgcattctactggtgctggaaaagcgatttcattttctggtgaagtttatgctgacaagttgaatg

SEQ ID NO: 5522 - DNA, 80 bp, Homo sapiens
tttgggtgacagtctctaagatgagtgtatctttaatatcttaaatataatatggattagatagaggttgatcactcaaa

SEQ ID NO: 5523 - DNA, 78 bp, Homo sapiens
ttgacttattttagaagtgttccttcttatgctgaaaagttcatttgcagctgaatatacttctatattttaactcaa

SEQ ID NO: 5524 - DNA, 87 bp, Homo sapiens
gcacttctttgaaagctctgaggagttgcctgaagcatctgggtgcttcttctcgtgtccctcccaacaagcttggacagggagtgc

SEQ ID NO: 5525 - DNA, 88 bp, Homo sapiens
tcaaccttgatgtttagttttccaaaaatatttatgtcagtcattcgtctacataaaatatgtaagggacaatagactcctaggttga

SEQ ID NO: 5526 - DNA, 80 bp, Homo sapiens
tcacaagtgctcatctgcatctgatttctcaactgcctcgttgagccaggttacaaaataatcagatgtgctgagtgtga

SEQ ID NO: 5527 - DNA, 65 bp, Homo sapiens
cgcgcgggtgctgcgagtcgggagccgcggccaataggctgcgcgttcccggccacgcccgcgcg

SEQ ID NO: 5528 - DNA, 74 bp, Homo sapiens
ggccataaggttgtcatgtttttccttttcacacaaaaagaggaacatagcaatatatttgatatactgtggcc

SEQ ID NO: 5529 - DNA, 80 bp, Homo sapiens
tctcacctcattaggcgtgaaaaaacataaattgagccctggtttgatttttgtttttcagaattttgtctatgaagaga

SEQ ID NO: 5530 - DNA, 74 bp, Homo sapiens
cctccaggccaggaaggctagggacgggtcctggtagaagacaccctgtctagaatggcccttggtcctggagg

SEQ ID NO: 5531 - DNA, 80 bp, Homo sapiens
agctacagaaggctagtgctgtgggcatttcaatgtaattatggagttctaagtacttgcccataaaaaattatgtggct

SEQ ID NO: 5532 - DNA, 73 bp, Homo sapiens
accacttctgcagttgatttacccatcctcgtgcaagagtatacagtggtgagaattttaatgcacgagtggt

SEQ ID NO: 5533 - DNA, 74 bp, Homo sapiens
tatccagaaaaccttgggaaggagactgcagctctttggagccccatggggtctctgcctttgatatttgggta

SEQ ID NO: 5534 - DNA, 64 bp, Homo sapiens
tttatagacatatttggaatggaggagatccacatgggatccttccgttcatttgttctgtaga

SEQ ID NO: 5535 - DNA, 71 bp, Homo sapiens
aggaagggaatggactgggagggtttcttttcctgatggaaagcctatttttcttattgtgttccttttct

SEQ ID NO: 5536 - DNA, 89 bp, Homo sapiens
ggctcctctgagacgagcaattcagacagggttgcctttctcccttcaaagctggctttccctgcttccctgtctccctcacgggagcc

SEQ ID NO: 5537 - DNA, 61 bp, Homo sapiens
agctgcataatacaatgggatttaataaaatgcctttaactcacaaagtttgtctgctgcc

SEQ ID NO: 5538 - DNA, 83 bp, Homo sapiens
ggcattcccagtcggctatatggtggcagagaaccctggatggggtgaggaatgggtgttgctatggatgctgtgctggtgcc

SEQ ID NO: 5539 - DNA, 77 bp, Homo sapiens
gcctgagatggaaagagagatggatgatttattgcttcaattgttttaaattaaaagctattctcacaatctgaggc

SEQ ID NO: 5540 - DNA, 64 bp, Homo sapiens
gccaattgagattgacatgtgctgttgtcataaatatcacactgtccaatttggtcaaattggt

SEQ ID NO: 5541 - DNA, 69 bp, Homo sapiens
gaagactaagttcacacactagagtaattaactacataattagtctagagtgaatcttatattgtcttc

SEQ ID NO: 5542 - DNA, 67 bp, Homo sapiens
gctggcagggcactgggaaggctagcaggctgcttcctctcagtccttcttgggttttgcccttagc

SEQ ID NO: 5543 - DNA, 63 bp, Homo sapiens
gggtttgaaaatattctattatggtgtgtatcatatatttttcataaagaatcatttcaatcc

SEQ ID NO: 5544 - DNA, 74 bp, Homo sapiens
tgcatgtgtgggctggggagggctctgaatatctcctggaacggtacccagagccctgtggctctgcgcatgcg

SEQ ID NO: 5545 - DNA, 89 bp, Homo sapiens
gagtccatcacaatgccagctatggccagaggcgtacagggacagcacggcctggatggccacgtatatggctggggtgtgaaggtctc

SEQ ID NO: 5546 - DNA, 82 bp, Homo sapiens
gttcaagtacagctggctccttctttgtggctggtttggggtttaggtgcagagaatggcttggggccactgcgtactggac

SEQ ID NO: 5547 - DNA, 72 bp, Homo sapiens
ctggggtgcagctggtaaccaccactatatcacaattatgtttggatgtagatgtgactccctgtattacag

SEQ ID NO: 5548 - DNA, 83 bp, Homo sapiens
ctccccctctcctttattttagtgtcttagaactcagctaagcatttgaacagtcattgctaagtgtttccacactgggggag

SEQ ID NO: 5549 - DNA, 87 bp, Homo sapiens
ctggttattggaaatccattgtgactgacagaacaaatgaagtctctttatgtttagtcagcacaatctgcatcttccttgtgccag

SEQ ID NO: 5550 - DNA, 62 bp, Homo sapiens
actgtgaatgggttatttttagggaaagctattaagctgttctctaagccacccattttggt

SEQ ID NO: 5551 - DNA, 60 bp, Homo sapiens
gtccaggtaggaggccaggaggtcgttcaggctttgcatgatctctttctcgttctggat

SEQ ID NO: 5552 - DNA, 73 bp, Homo sapiens
gaggcctaacagtcaaatgtctatcttcttctcatcaccaagaagtgatgctacgactttgacatagtgtctc

SEQ ID NO: 5553 - DNA, 90 bp, Homo sapiens
ggcggggacagtctgattgagctgtgtaagttggaagcagcgagacattgcattccagctctcatactctgggaacgtcacctacctgcc

SEQ ID NO: 5554 - DNA, 61 bp, Homo sapiens
agaattacaatatcaatgggaagttatcatgcaataaccttctattgatttgtgtattgcc

SEQ ID NO: 5555 - DNA, 77 bp, Homo sapiens
aggacatcagaaccaattgggttagagagggcctaataaattgtgtccctcacaaggacccagcattttctgttcct

SEQ ID NO: 5556 - DNA, 90 bp, Homo sapiens
cctatctctcccaagtagcccccttaccccgagtgtgaactccaagagtggaagactggggccgggggtgggcatcactgggaggactgg

SEQ ID NO: 5557 - DNA, 71 bp, Homo sapiens
aaatatattattgttatgcatttgcactatagcagccactacaataccaggtgaatactaatgatatattt

SEQ ID NO: 5558 - DNA, 78 bp, Homo sapiens
tccctggaatgctgccccaaaggatggttatcaatctatctctcataattggtaactgtggatcagtggcccagagga

SEQ ID NO: 5559 - DNA, 60 bp, Homo sapiens
aggtgtggtttttgtcatgtagcagtttttatgtagatctatatataaaagtccacacct

SEQ ID NO: 5560 - DNA, 75 bp, Homo sapiens
ggggtaggggtgtgggccggttgccaagcccagtttagggaccccacagatccctgcagcccacggccctgcctc

SEQ ID NO: 5561 - DNA, 62 bp, Homo sapiens
aacagcataaaaatgtatggagttgtataaatttgaatacaaaatgcatttgttttgtttgc

SEQ ID NO: 5562 - DNA, 90 bp, Homo sapiens
ctctgcccagcattttgcgggccgattaatcgctgccttcaaggactcccaaggcagtgactgccctacaatcagagtgttgtggttgag

SEQ ID NO: 5563 - DNA, 61 bp, Homo sapiens
agccaggcggggggatggactccctgaccctcagcttcagccccagtccgtctgccaggcc

SEQ ID NO: 5564 - DNA, 78 bp, Homo sapiens
aaaacagccagtactaaataggaataaataactcccttgttgaattctctcatttattctctctttagctcctgtttt

SEQ ID NO: 5565 - DNA, 72 bp, Homo sapiens
gagtgcctggggcgagggtctggggtggggcatgccaatcaggcgccccacccccgccctgcccccaatctc

SEQ ID NO: 5566 - DNA, 89 bp, Homo sapiens
cctggaacttttagtttgcagagtcaaagctatgctcactctcaacaattgtagagaggctttctggctgggcaatctaaaaaaccggg

SEQ ID NO: 5567 - DNA, 87 bp, Homo sapiens
tgtctccttaggcaaaaagctgctttggagaaacattttcatttctatcaagaactccataaggaagccagtggcctgcagtggaca

SEQ ID NO: 5568 - DNA, 77 bp, Homo sapiens
tgtccaaatgtagaccatgggttcatctggagttccttgtccgtgggaacacagtgttctattctactctgaggaca

SEQ ID NO: 5569 - DNA, 85 bp, Homo sapiens
cacctccatgagaaggaacgccatgggagtcggcttggtttttgaagctgatctctttaccacgaggcacatttctcactgggtg

SEQ ID NO: 5570 - DNA, 61 bp, Homo sapiens
agtaaaaagcaaagaatcaaatccatccaaaaaatgatgtaccaattcttgcttttttaca

SEQ ID NO: 5571 - DNA, 85 bp, Homo sapiens
ttctcactgcccccgggtacctccctctccttcgtgctcggggagagctgtgccaaggaaaatgcggatttggggaaagtgagaa

SEQ ID NO: 5572 - DNA, 73 bp, Homo sapiens
ttggatactgtttaagaatgttagttccaaaggacattgttttttggctcttgtattttgaagggctatttaa

SEQ ID NO: 5573 - DNA, 80 bp, Homo sapiens
gttcctactttgagggtgtgggtgacaatgtctctaccttttgggaatctcacccctcatttcaaattcatggtaggaat

SEQ ID NO: 5574 - DNA, 69 bp, Homo sapiens
gtgtggtcacagtggtgggcaacttgggcatgatcacactgattgggctcagttctcacctgcacacac

SEQ ID NO: 5575 - DNA, 66 bp, Homo sapiens
gtgaagcgcatcttgtatattgctagttgaatagagcccaattggcgagttataggaagcgctcac

SEQ ID NO: 5576 - DNA, 80 bp, Homo sapiens
cagaattattgccctttgatttttaatacatatccttttgttcttgtattaaaggacaagttaaaggagtagtgactctg

SEQ ID NO: 5577 - DNA, 69 bp, Homo sapiens
gatttatgagagggaaaagtaggtcaaatttggggccagccaaatggcctctctccatctctttaaatc

SEQ ID NO: 5578 - DNA, 82 bp, Homo sapiens
attcctctgctatgaggactgttgggtggatcaccataggaagttgggtaatatgatggagtctttatagtgcaggaggagt

SEQ ID NO: 5579 - DNA, 70 bp, Homo sapiens
tgggacattgcttgatgattcatagtaaggtcctttagacattaatgtgagttatctaagtacagtccta

SEQ ID NO: 5580 - DNA, 78 bp, Homo sapiens
tctcatttggaaacatgaatcacagcttattgtttgcaagtacttggaatctgttagaagcattgtttgtaaatgaga

SEQ ID NO: 5581 - DNA, 82 bp, Homo sapiens
ttgtgcagctcctcttcttaactgttgaaaagtgctcattagtcctcaaatagttatttggactttagggtagagcgcacaa

SEQ ID NO: 5582 - DNA, 84 bp, Homo sapiens
atgctgagcttgggtctgagaccatgtgggggtggcagctggaaacgtgggtgtcatccaagttttggctcagcaactcagcgt

SEQ ID NO: 5583 - DNA, 79 bp, Homo sapiens
gctgaggctggggctgggtcagcaaccgaattccagtttagaggcggatttggtcgtggacgtggtcagccacctcagt

SEQ ID NO: 5584 - DNA, 66 bp, Homo sapiens
gatgtggtcggagcagctcctgactgtgacaccaagccgggaggctgcatcgctaatgaccacatc

SEQ ID NO: 5585 - DNA, 77 bp, Homo sapiens
agtcaaggtgatatatgcctctaaatccctcggaaagcacccaagggcagaggccagaaatcattataagcttgact

SEQ ID NO: 5586 - DNA, 83 bp, Homo sapiens
ctctattgtgcagccttttactaacactcttttcacaattctggctgagagaggaatgtgaataaaaggcacaagcaattaag

SEQ ID NO: 5587 - DNA, 72 bp, Homo sapiens
cctctaaatccatgtgaataatgcatttaatgccagcacttcaatgctggaaagatgttcatgatttggagg

SEQ ID NO: 5588 - DNA, 82 bp, Homo sapiens
cttcatagtattatcataaaatccacccggcttcaccattactgtgacatctgaggctggagaaaatgatgaaactgtccag

SEQ ID NO: 5589 - DNA, 81 bp, Homo sapiens
ctggggtattacgtatttccccaactattgtacctgatgtcaataaaggtgcatttagggaaatttgaactaaaaccccag

SEQ ID NO: 5590 - DNA, 82 bp, Homo sapiens
ggggatgggagggtgggtatgcaggccctgtcttacgggtacctgggccctgttctgacctctctcctctccttccatctcc

SEQ ID NO: 5591 - DNA, 88 bp, Homo sapiens
gctggggcccacttgggccctctgcagctgcccagggccccaggaggggtacaaacctgggacaagcaggggcccaaccacccccagt

SEQ ID NO: 5592 - DNA, 88 bp, Homo sapiens
cagtgacctgttctctgcctctccagccgttcttcacctgctcaggtgagcaacacctggagcccccacagcacagaggaggggactg

SEQ ID NO: 5593 - DNA, 61 bp, Homo sapiens
gacaccacaggaatattgcaactgacagtgcatggggtgcgacaatattccatttgagctg

SEQ ID NO: 5594 - DNA, 90 bp, Homo sapiens
gtgaacttgaaaatagcattgcttcgtgcactttgaataccaatcaggtgttttctgtgctactagttgtcacgttgcattcatgttcac

SEQ ID NO: 5595 - DNA, 77 bp, Homo sapiens
ccactgtagaaaatggatatcatttgaatcttggatgcagtcatccaatttttctattgttcattaagcagcattgg

SEQ ID NO: 5596 - DNA, 74 bp, Homo sapiens
ccgggcagcctgatcactgactattgcaaactgctgagtgtatagtaattgtcagtcatctaaggtagccccgg

SEQ ID NO: 5597 - DNA, 77 bp, Homo sapiens
gtggcacttgtatgtaatttattatggctgtaatggaggctgcccctcgctgccacggcttaaattaaatgtgccac

SEQ ID NO: 5598 - DNA, 89 bp, Homo sapiens
tggcaattttatattcctttgtctgttcagattccaagggagtttaggttcagcttacagtcttttggaatgtttagagattattgcca

SEQ ID NO: 5599 - DNA, 64 bp, Homo sapiens
acaagaagaggaagtctccatggagagttctcccgagtctcaccatggatcttccatttcttgt

SEQ ID NO: 5600 - DNA, 72 bp, Homo sapiens; identical to SEQ ID NO: 5083

SEQ ID NO: 5601 - DNA, 84 bp, Homo sapiens
gggaaagtgctgcctctcaccgagggctgaatggtgatttgccattcacggtccaggttgctctacagagaggcacagactccc

SEQ ID NO: 5602 - DNA, 90 bp, Homo sapiens
tgttccaccgcgcatgtttcaaatgcttcatgactatcactgataattgagcaattaacttgaaattaccaaatgtgctgtggtggcaca

SEQ ID NO: 5603 - DNA, 63 bp, Homo sapiens
agtctgcccgcacggcatgcacatgcgcggtgagctgcaacacagtgtggctggcgggaggct

SEQ ID NO: 5604 - DNA, 68 bp, Homo sapiens
gtgtttacttgtaactttctggttatatactgcttatatctgtggattcaagttactgaagtgaatac

SEQ ID NO: 5605 - DNA, 73 bp, Homo sapiens
ctctgcggaccattctctggatgctgaatgtcccactattacatctcggcatgacatttcatggccagcaggg

SEQ ID NO: 5606 - DNA, 84 bp, Homo sapiens
gctgtaatttttctatatgacagttcagttttaaaattgtaaagatgccaaaagcagggctgcattgttattagggaagtcagt

SEQ ID NO: 5607 - DNA, 79 bp, Homo sapiens
gtcatctgttatttagttgtcattatgaactttttgggttgcatatcaatccattttccatgtttactaaacagatggc

SEQ ID NO: 5608 - DNA, 78 bp, Homo sapiens
ggatgggggtccgcccagcagtccctctgctgacccagcgaggctctggggaaggcaaggactcggggacccctaccc

SEQ ID NO: 5609 - DNA, 74 bp, Homo sapiens
cactatgttgtagccacagctggagcctgggtcctctgcacagagactctggtctgggtcttgacaagatggtg

SEQ ID NO: 5610 - DNA, 86 bp, Homo sapiens
ttccgtattgcacagggatggattgtcttcacctaagtttctacttaaataataatgaaaacgggattaaccctggcagtaaagaa

SEQ ID NO: 5611 - DNA, 85 bp, Homo sapiens; identical to SEQ ID NO: 4116

SEQ ID NO: 5612 - DNA, 69 bp, Homo sapiens
gtaattatgtaataaatgcatatagtacatgctaattactatatgattacacagtaattacatggttat

SEQ ID NO: 5613 - DNA, 61 bp, Homo sapiens
acttgttcttgatcatttaaaaaaatcactaaaacaacatgtcaagtgatattgagcaaat

SEQ ID NO: 5614 - DNA, 78 bp, Homo sapiens
gagtctggctcagggccaggaataagggaggctataaatccatagcatgttatagtatttcaggatgatgtcaggctc

SEQ ID NO: 5615 - DNA, 81 bp, Homo sapiens
gggtgaatgttatgttggcagctccgcattctaggcctaaggtttggagggcacagggaatgctgacaggccataatacct

SEQ ID NO: 5616 - DNA, 67 bp, Homo sapiens
atataaatcaaagctgttatttttatttctgagtaaatttgctcaagaatagaattgaggtttatat

SEQ ID NO: 5617 - DNA, 72 bp, Homo sapiens
aaaaacttgatgtctactgtgattacagctgttgacccaaccaattgttgctagaatcagagttaagttttt

SEQ ID NO: 5618 - DNA, 88 bp, Homo sapiens
ctgcctagaaccttttctgaatccctttgcattttttaataagattcaaaaccataaattatgtaaagccagagagctaaaagggcag

SEQ ID NO: 5619 - DNA, 77 bp, Homo sapiens
tggtgaggcttggctgggcctgtctgctgttggaccaaattggactgtattatatatgggccacagttaaatcacta

SEQ ID NO: 5620 - DNA, 74 bp, Homo sapiens
tgccaaacatctggatgaaaagtaaaaagtcagtcaattatctagatatttttccaatacccagatgtttggca

SEQ ID NO: 5621 - DNA, 60 bp, Homo sapiens
ataaatacatgaaaaattatacttgatagcttaactataatcagctatttttgtattttt

SEQ ID NO: 5622 - DNA, 78 bp, Homo sapiens
gctacgggaaatgagctactcagcattaatgtgtaactttactcttctgcttaaaagtagttaaatcatttccccagc

SEQ ID NO: 5623 - DNA, 71 bp, Homo sapiens
cctttttaaatgtgctgaatcatggttagttcctctatttgagagcttacctctgatcagcttggaggagg

SEQ ID NO: 5624 - DNA, 87 bp, Homo sapiens
ttgtaggactttgactgtaagatgtgaaaccacgtttcttgcatgatgttttagagattatttcatttacagtcttttaacctgcag

SEQ ID NO: 5625 - DNA, 73 bp, Homo sapiens
gagaaacaaaggaagagagaggctgagggtcctgtccatgagccagggtctcctcgcctgacctttgtctctc

SEQ ID NO: 5626 - DNA, 81 bp, Homo sapiens
tgactggctatagctacttagagaacagaggaaattcattaaaaataatgaattattcagttgggtagtgaaatccagtta

SEQ ID NO: 5627 - DNA, 83 bp, Homo sapiens
tcctcaaaagcaaatagcagactctgaaggttaatgtaatatgtacagcattcccatttcctttctttctgttgtgttgagga

SEQ ID NO: 5628 - DNA, 82 bp, Homo sapiens
gagataaagcaaattccattgtagaatcatatgatcatttagaatcatatgtttctgggaacaatgaaagtatctttaactc

SEQ ID NO: 5629 - DNA, 79 bp, Homo sapiens
gtctcaccttggcgctcctggctcagcagccagtgtttgccctggctgcctgggctcggattacgcaaggctggtgggc

SEQ ID NO: 5630 - DNA, 89 bp, Homo sapiens
taatgcttgactggcatgttataaagctaatttgtttatagttgtgccacataattatacactctgtacataatatgcttttgaaatta

SEQ ID NO: 5631 - DNA, 75 bp, Homo sapiens
ggggcctaggcagtcctgggaccccaggccatgggtgagcgagcctatcatggggcccaggtgtgctctggcacc

SEQ ID NO: 5632 - DNA, 77 bp, Homo sapiens
gctggaactatttgtccctagttactcatgttttatgtattttaaaagataaaacagggacaaaaacaagtagcagc

SEQ ID NO: 5633 - DNA, 83 bp, Homo sapiens
ggacacagtaaatgaaggagctaggattcaaactcagggtctgtctgagctcagagccaaagctctttcctttacacagtgcc

SEQ ID NO: 5634 - DNA, 78 bp, Homo sapiens
tttggaaaccagtgaaaatcaatagggtaaatatcatcaggaagctttactatttgagttgtttcactggttaacaag

SEQ ID NO: 5635 - DNA, 77 bp, Homo sapiens
tctcagaaagttattaaagtgatgggaatatagagcataataaattctcattctatttgtgaataattttcctgaga

SEQ ID NO: 5636 - DNA, 63 bp, Homo sapiens
cgagtccactgtgtccgcgtttccattttgaaggaaaatgggagaaatgaggccagtggtttg

SEQ ID NO: 5637 - DNA, 82 bp, Homo sapiens
tcagcctctggtgcgcagaggccagggggcgcgagcatgaacagttcaggctggccccccgggggccgcgcgctggggctgg

SEQ ID NO: 5638 - DNA, 76 bp, Homo sapiens
gcatttatgtataccttttgaagggtattttggatattaaattcaagaagctataaactttaaatatattaagtgt

SEQ ID NO: 5639 - DNA, 78 bp, Homo sapiens
atggggctgattgaccccatagagtgctggatgagaataaatctcaaagtgagcattttgttgttagttaagtgccat

SEQ ID NO: 5640 - DNA, 84 bp, Homo sapiens
cttccaagaaaccaaagtctttgggtttttaggttccggggggagtacggttgcaaagctgaaacttaaaggaattggtggaag

SEQ ID NO: 5641 - DNA, 67 bp, Homo sapiens
atttcctctgtgaagggagtaggatgaagtaccacagttttattaacttcctattacaggaagaaat

SEQ ID NO: 5642 - DNA, 86 bp, Homo sapiens
ccttcccacttccttctgtgacaatgctgacttcagggggaaggattgctccttctctgtcaggagtctgagagggtgtggggagg

SEQ ID NO: 5643 - DNA, 68 bp, Homo sapiens
gagtaagggtggtagatccagttttggcaacctcagacgatggatgattagactctgccactcttctc

SEQ ID NO: 5644 - DNA, 87 bp, Homo sapiens
tgattggctggaaaactccgctgggagcgtacctccttcggtgattggtgaagagaagggggcttccgaggacagtctggccagtca

SEQ ID NO: 5645 - DNA, 75 bp, Homo sapiens
gaaggcaggcaggcacctgtaattatagcagcagtgatgaattgcagctgaattgcatggtgtgttaaggctttt

SEQ ID NO: 5646 - DNA, 89 bp, Homo sapiens
tttcatccgccacccgcagggcgagctggaccacagtctgcttgtggacctgtgtgcatatcacgcccccgtgctggtagtggatggaa

SEQ ID NO: 5647 - DNA, 66 bp, Homo sapiens
gttttattttttgtgtttagtcttcgtccatagtaacaattataatgaatgcatcaaaaataaagc

SEQ ID NO: 5648 - DNA, 72 bp, Homo sapiens
ctgttcttatcgtcttaatatctgatacgtcctccatctgaggacaacatattaaatggattttgggagcag

SEQ ID NO: 5649 - DNA, 70 bp, Homo sapiens
cccaactggcttgggggcaggacaagggctaggcttgatggtggccaggcttgcctgctccccacctggg

SEQ ID NO: 5650 - DNA, 75 bp, Homo sapiens
agcagatgccccggcgggcctgctcttgtctctgttccctcaggttccagtttagagcctgccttgccctctgct

SEQ ID NO: 5651 - DNA, 77 bp, Homo sapiens
tctgggctggattcacgtctatgtaattcactgtgagaattcccattgaattacacaggacaataattagacccaga

SEQ ID NO: 5652 - DNA, 70 bp, Homo sapiens
aaggcaggtcgaactggagctggctggggagctcattagcacctcgccagagccgagggctgcctgcctt

SEQ ID NO: 5653 - DNA, 82 bp, Homo sapiens
tttgtttttctgggtcctggccaggcggcatcagttgtgaaaaggaacgaagttgctcatggccccgtctcagattgacaga

SEQ ID NO: 5654 - DNA, 79 bp, Homo sapiens
ccctaaggagctgtaagagtagcgtaagcatcaatctctaaggaatggcttaaacactatgttttttgctcatgtaggg

SEQ ID NO: 5655 - DNA, 78 bp, Homo sapiens; identical to SEQ ID NO: 4599

SEQ ID NO: 5656 - DNA, 62 bp, Homo sapiens
ggggaggtggggacaggggtgcgggaggacccaggtctcctcactgtctgcctcaccactct

SEQ ID NO: 5657 - DNA, 68 bp, Homo sapiens
cttttctatggtgacagtgattgcccttgatgtattctgcaggtcagtcagattgtatcacagaagag

SEQ ID NO: 5658 - DNA, 80 bp, Homo sapiens
aaatgccctgttggattctgagctgtggttttcttttctccaatttagctcaagagtctagttcctattctacggcattt

SEQ ID NO: 5659 - DNA, 89 bp, Homo sapiens
gggtgtattgcagctgcttaattttttctgcttttctctgacagtcactgagagaatgcctggcgattagtgtagctgctaaaaggcct

SEQ ID NO: 5660 - DNA, 71 bp, Homo sapiens
ggaactgcaggagttaaatacatacattattattttgatgacagaaaaggcaatgaatgtcttgcagctcc

SEQ ID NO: 5661 - DNA, 68 bp, Homo sapiens
cttttttacctggagatctaaactaagtaggctttgcttggtgtcatttaagtctccagctgaaaatg

SEQ ID NO: 5662 - DNA, 61 bp, Homo sapiens
agcatcatttcttggctgtgttaatttttaataagctagttgcatccaacctaatcatgcc

SEQ ID NO: 5663 - DNA, 76 bp, Homo sapiens
gtgaactattatctgtcggaaaatctaattataagtctgataataattggactagatggccagatgacagtctcac

SEQ ID NO: 5664 - DNA, 81 bp, Homo sapiens
ggcttggttatgggggcagtgggggctgtaactggcttcgtatgtggccatttcctgcctttggtgcagttaaaccaagcc

SEQ ID NO: 5665 - DNA, 70 bp, Homo sapiens
gaaattgagagaagagaggtcaacatactgtaaatacatatagttgtccaatgcttctctggccaatttc

SEQ ID NO: 5666 - DNA, 89 bp, Homo sapiens
cctgagaaggcccagaggagattaatcatagcatttttctcagtgctgcatcaatctcacttcctctcaatttgggctcaatttacagg

SEQ ID NO: 5667 - DNA, 87 bp, Homo sapiens
ttgccttccaactaaggaccattagttgtgattgatcatatctggattttaccaactatattaagcaataaatgcttctttgggcaa

SEQ ID NO: 5668 - DNA, 71 bp, Homo sapiens
gatcacgggagttgttgattcagacttactggtgctttatgagttgaagtcttcaataagcttaaatgatc

SEQ ID NO: 5669 - DNA, 82 bp, Homo sapiens
cctcggcgctttatggccaagcatatacagattgagttttcagaacataatttgtgcttgggtctttctgcgatgaccgagg

SEQ ID NO: 5670 - DNA, 79 bp, Homo sapiens
gtaacctctgcaaggagatattttttcttcttttcagtgataggaaaagagccaattaagcttcgtcctgcagaggtac

SEQ ID NO: 5671 - DNA, 85 bp, Homo sapiens
tatttttgcatagtttcttggtttaaaatactgtgaaaggaatttatttttaaatgtggaacctgttactatgacatcaaaaatg

SEQ ID NO: 5672 - DNA, 74 bp, Homo sapiens
cccgcgcccctggctcccgggccatggcgctgagggagctcaaagtgtgtctgctcggggtgagtggcggcggg

SEQ ID NO: 5673 - DNA, 87 bp, Homo sapiens
tcataagtcctctgtttatatttttaaaacctgtactctttccaagcctctaggcaagaacaaatagaaataatcagaggccttaga

SEQ ID NO: 5674 - DNA, 61 bp, Homo sapiens
ttataatgatttcttatgctcatttttatataaaagaagaggaaatgaggaatcattatga

SEQ ID NO: 5675 - DNA, 78 bp, Homo sapiens
ggtggcgttatttgggctttaagaatgcaaattgttgtttttagtgcattcattggcctagtgattctgacagccacc

SEQ ID NO: 5676 - DNA, 79 bp, Homo sapiens
tgaactctcaccggctccccagccctccccaccaaggggtactgcaggggaagggctggctggggtccccgagatctca

SEQ ID NO: 5677 - DNA, 82 bp, Homo sapiens
ggggagttggcctggagcttctgtaaacagagtgtcagaggcaggaagaggctctggtgatgagcagcccagctggatcccc

SEQ ID NO: 5678 - DNA, 88 bp, Homo sapiens
gcaggagtgctgttaatggattttatggctttgttgagtacctcaaactacagttattaattagaggatgctgtttaggcactcttgc

SEQ ID NO: 5679 - DNA, 78 bp, Homo sapiens
aatttttctgggctgagtgtttagggaacaaggaagtttgcttccatgagccttgctttgacttagtgcagaaaaatt

SEQ ID NO: 5680 - DNA, 88 bp, Homo sapiens
gacaatgttttaaattttagagtcacattttattctgatcagaatttttattgagatgttgagcttttgtttttgaaactagtttgtc

SEQ ID NO: 5681 - DNA, 83 bp, Homo sapiens
gtggcaaattacctacactgttcacaaaccagcaggcagccctgtttgccagctatccgaattgtttctgggtaatttggcac

SEQ ID NO: 5682 - DNA, 89 bp, Homo sapiens
tggagaggccagactcatcatactcctggcttgctgacccacatctgctggaaggtggacagcaaggccaggatggagctgcccatcca

SEQ ID NO: 5683 - DNA, 61 bp, Homo sapiens
atgaaaacctaaatattggagggggaaaataccacactaaaccgatctttatgtttctcct

SEQ ID NO: 5684 - DNA, 66 bp, Homo sapiens
tataatctgactaatccaggcaatggaaatttgcttaacagatttgcatgctgttttcagattgtg

SEQ ID NO: 5685 - DNA, 90 bp, Homo sapiens
ggctgcactcatgaggtaacccaggtgtttgaccgtctaggatgtggaaatacgcaaggcagtggcgcctgtgccaaatgggtcacagcc

SEQ ID NO: 5686 - DNA, 84 bp, Homo sapiens
gttctgctctcctcttggtattatgcctggtatagctgctccagtctgagccagtttaattagttcaagatagagatgtagaac

SEQ ID NO: 5687 - DNA, 76 bp, Homo sapiens
ggcttacagaattatgaacagtggatagattaaaggcatttaatatttgtaattcataataactgtagaaatggcc

SEQ ID NO: 5688 - DNA, 81 bp, Homo sapiens
cgtggcagggttaacagccactgagggtgggtacaatgaagagagtcactttctgcaccctcagggacttcccttgtgatg

SEQ ID NO: 5689 - DNA, 70 bp, Homo sapiens
gattatgaaagttctcagatgtcaggatgatgagtttggtcatcatcttaggcagaggagagatatgatt

SEQ ID NO: 5690 - DNA, 87 bp, Homo sapiens
tagtttcatattcaattacgctgtttagagttaatattgaattatgaatattgctctatttagctttattattgtattatggatctg

SEQ ID NO: 5691 - DNA, 77 bp, Homo sapiens
aggatctgttgttcattaccccatggcatcctttcaggacaaccccagagggtgttgtgatggggagcagcaggcct

SEQ ID NO: 5692 - DNA, 77 bp, Homo sapiens
agaaggctgagcagcagaggcagcaagagctagctgcacatacccagcaacagccttccacttctgatcagtcttct

SEQ ID NO: 5693 - DNA, 87 bp, Homo sapiens
aggtagatcataaatgagatgagtgcttgaatttgattatgaaaaggtatttttaatacagacactcgctctgtgtatcaactacct

SEQ ID NO: 5694 - DNA, 84 bp, Homo sapiens
tttgactcccatggaaagagtttaagccatgatttggtcattgacctccaatgtttgctctgacttcttacaggggagttcaaa

SEQ ID NO: 5695 - DNA, 73 bp, Homo sapiens
ccttctgggttcaagttttggctcttcagggcgttagccttattagccgcagctgtctggggaactcagaagg

SEQ ID NO: 5696 - DNA, 70 bp, Homo sapiens
agctggagggaagggctggaagaccaatccctggagagcagaggtcagcacagcccttaccctcctagtt

SEQ ID NO: 5697 - DNA, 73 bp, Homo sapiens
ttggctgagaacagggtcatttgatctttgagcgagccctcatgtttgccagaggtgctcctggtccagccag

SEQ ID NO: 5698 - DNA, 78 bp, Homo sapiens
agccttcccctggtatttagaactatttctcctaagagatataatgatatatggaggaatttaatcttcagggtggtt

SEQ ID NO: 5699 - DNA, 88 bp, Homo sapiens
cctgttgccagcatgtccactttctacaaaatgggtggtctttttctttactctaccttgtggagaggataatttgaagggctacagg

SEQ ID NO: 5700 - DNA, 67 bp, Homo sapiens
gggtttattcatagatttgtgttagtaaatggcaagcttcttactaattagcaaattgtgtaaatcc

SEQ ID NO: 5701 - DNA, 87 bp, Homo sapiens
cagacaaaatgcacatattctttgcttctgttggccaccatctgtttgagatggctggggaaggggcagagaagaaagcacttgctg

SEQ ID NO: 5702 - DNA, 80 bp, Homo sapiens
tttgggtgacagtctctaagacgagtgtatctttaatatcttaaatataatatggattagatagaggttgatcactcaaa

SEQ ID NO: 5703 - DNA, 85 bp, Homo sapiens
gagttcatcttccttctttcaggttgatgattttagtcattttacatgcacaattttattcatatgagaaagggaggaaaaattt

SEQ ID NO: 5704 - DNA, 77 bp, Homo sapiens
ctgaaaaatatgtcatggagaatttaccatttaaatgggatgacatttaaataattccttttgttcatgtttttgag

SEQ ID NO: 5705 - DNA, 88 bp, Homo sapiens
tgggtcaaatgaggttattggattatgtttgtagccaattataattgttttggttgaatactctctcttgtaaccttatttacactta

SEQ ID NO: 5706 - DNA, 76 bp, Homo sapiens
caattacattgtaaataggcttctaactaatgggaatactaattattcttatttgtgcatatattagaatgaattg

SEQ ID NO: 5707 - DNA, 78 bp, Homo sapiens
catatgttgtggttaggcatttaaatattctgtagtatgtatatctgaattgtttgatcggtgtaatctaagcatatg

SEQ ID NO: 5708 - DNA, 89 bp, Homo sapiens
cattatggaaaaatatatagcactccacagactaacttaaaatgccaggaagtgacttgagctgagttagagtctatggaaccatagtg

SEQ ID NO: 5709 - DNA, 90 bp, Homo sapiens
agataacttgggttcaaagtctgtttttctttatggagtcttagagaagatagtaattgggaaagacatcttcttaagatctaagtttct

SEQ ID NO: 5710 - DNA, 88 bp, Homo sapiens
gctagtgtgttgttttaaaagaacctgatggagagctatgatcatatgtaacactgcctctagttagtttttaaataacacttgtagc

SEQ ID NO: 5711 - DNA, 85 bp, Homo sapiens
aaagcctgtggggttgttttataaaatgagaaggtggtggtttaataaatgctgggccacctgaggcactttcattaaaggcttt

SEQ ID NO: 5712 - DNA, 84 bp, Homo sapiens
caactccattaagtaggcaaagttaaaacatttaagagtaaagtctctcttaaacaaatatattaactacatttgtggagcttg

SEQ ID NO: 5713 - DNA, 76 bp, Homo sapiens
attatactctgtcggtgccaggttgttgaaaataagggattgagatcaggagtctggggaagttgacagatataat

SEQ ID NO: 5714 - DNA, 79 bp, Homo sapiens
agtagatgaggagcaaatgagaatcttggataaaggcctagaccttgatcatggaggattttatttgttttttgatatt

SEQ ID NO: 5715 - DNA, 78 bp, Homo sapiens
gagttagaatgttttagtttgaagcaatgtgctgtatattttattagctataacttgcttaattattcattgtgactc

SEQ ID NO: 5716 - DNA, 72 bp, Homo sapiens
gatggagaaggtggcaggcagtaatggagacagaatttctgttaactgctgtaattaatgttatgtctcatc

SEQ ID NO: 5717 - DNA, 68 bp, Homo sapiens
tgcccttctcctctaatgttgggtctctcttgggcacagatggttctagcttaggggcagccagggca

SEQ ID NO: 5718 - DNA, 83 bp, Homo sapiens
ggttggcatccttaggccgctttagctggactttgaggcgcttcatgccgatctggaagccattcatggcctggatggcagcc

SEQ ID NO: 5719 - DNA, 79 bp, Homo sapiens
cagatgttaacaacttaaaggctggttttttgtaaacatttacattaacaaccattacctattaagagtgaaatatctg

SEQ ID NO: 5720 - DNA, 80 bp, Homo sapiens
gcttcttttccctgcaagtgctttgtcatgctgatactctgacccaagaaagcatttccaaagagcctgcgggataaagc

SEQ ID NO: 5721 - DNA, 65 bp, Homo sapiens
cccaaactgttgatttaagttgtcaagagagcttgactcatgcttagacttgacaacagtttggg

SEQ ID NO: 5722 - DNA, 60 bp, Homo sapiens
tgtattacattaatatatcatcaaagccatggcattgttatgatatattactttaataca

SEQ ID NO: 5723 - DNA, 85 bp, Homo sapiens; identical to SEQ ID NO: 4116

SEQ ID NO: 5724 - DNA, 89 bp, Homo sapiens
gtctggaaaatgatagatgcctaaaattgatcagggtaatcgatgctacgtgaagtatttacacatgatggatgtatcatctgccagat

SEQ ID NO: 5725 - DNA, 85 bp, Homo sapiens
gattaccataactcattttcagagtcaactctctcaattctaattagaattagaagtttctgaggaatcctgggtacttgtaatt

SEQ ID NO: 5726 - DNA, 85 bp, Homo sapiens
gtgatgctatgctctttaaaggaaatggtgacaagtcttgaattgaaaattgtattcaagaaatcattgagcagttagatatcac

SEQ ID NO: 5727 - DNA, 82 bp, Homo sapiens
ggggaagccctgtgtccccctcagccataggggtcaccagctggagctcaggtggctgaatggggtctctctcgctgtcccc

SEQ ID NO: 5728 - DNA, 84 bp, Homo sapiens
gcaaggggccaagagggagatgcggatgaaatggatgatttaatgggtcatctctcctgtagttaatttctctagatctcttgt

SEQ ID NO: 5729 - DNA, 74 bp, Homo sapiens
aagagaaaaactaatatatttgagatgttccattttctgtataaaagggaacagtgtggagatgtttttgtctt

SEQ ID NO: 5730 - DNA, 72 bp, Homo sapiens
ttttctgtagttttaaaaagtgacagtatgaagtgcacaaaatcatattaatcattattttaaaaaagaaaa

SEQ ID NO: 5731 - DNA, 64 bp, Homo sapiens
gttcctcctgtccatcctggggctggccggctgcatcgcggccaccgggatggacatgtggagc

SEQ ID NO: 5732 - DNA, 70 bp, Homo sapiens
atttagaaatgcttcttcttcatctagagaagtaaaaataattataatagaaaatgggtaatttgcagct

SEQ ID NO: 5733 - DNA, 82 bp, Homo sapiens
cctcaccctagcccctctctgagtcactgggctgtggggaggacagacagtggggactctgttgagaggagctgtggtgggg

SEQ ID NO: 5734 - DNA, 76 bp, Homo sapiens
catagcaaatgaattaagcatttcttttacatatattgtactcaatataatggtttgaaaagtaatttatgctatg

SEQ ID NO: 5735 - DNA, 74 bp, Homo sapiens
tttgccaatctgttggagaccctggcttcattagcaccaagctctgacccaagggggcccaacactatggcaaa

SEQ ID NO: 5736 - DNA, 82 bp, Homo sapiens
gcagccaatggtgggagatggcagagtccctgacaagaggatgatgtcagactcagcctgaagcactcagcatctggcttgc

SEQ ID NO: 5737 - DNA, 72 bp, Homo sapiens
atttggataatgatttttctgattaaatttgttgtagacagacagaaaacagaattagatcagtattgagat

SEQ ID NO: 5738 - DNA, 69 bp, Homo sapiens
cagcccccgccgctggggttgctgctgtagtgcgccttgaaggcggcagccacgtagtggtggtggttg

SEQ ID NO: 5739 - DNA, 76 bp, Homo sapiens
gtgtatttaaatatatttagccatgtttacttgcacattcctaaattaggcctgaataactggctgatagatacat

SEQ ID NO: 5740 - DNA, 73 bp, Homo sapiens
ctgggaaggcctctggggctggaggggcagggggccaggcttattcccccggtcagcctcaagggcttctggg

SEQ ID NO: 5741 - DNA, 82 bp, Homo sapiens
gtgggtttagtctgggaaaacaaaacttctgactcagcctgggtctcctcagacagtgggctaggaagacccagaaaaccac

SEQ ID NO: 5742 - DNA, 83 bp, Homo sapiens
cttagagatggctggactccctgcagaataaagaagtggcattactgctgctgcttatgaagggaacagcttgtaaatctagg

SEQ ID NO: 5743 - DNA, 69 bp, Homo sapiens
tcaggtgtctttctataggccttgttgcttagctacaaagtaaccaggaaagcttaatgaaacatctga

SEQ ID NO: 5744 - DNA, 89 bp, Homo sapiens
tttctattggtaatgattgagttcacctctttcagaagacattttctttctcttctgagtaattgaaataaaatctggcccttgtgaaa

SEQ ID NO: 5745 - DNA, 69 bp, Homo sapiens
tcacaataactgtgcatcccttcagagtaatgtcaacattttctggaatgtcgacagtctgattgctga

SEQ ID NO: 5746 - DNA, 73 bp, Homo sapiens
gcaagtgctggatcagctcttgttggaagcgccagatgtgtcggaagaggacaagagcgaggaccagcgctgc

SEQ ID NO: 5747 - DNA, 70 bp, Homo sapiens
gaccctttgtagagtgacaaaggttggaattctgattctcgtgagtcaaattttggcctttgactgggtc

SEQ ID NO: 5748 - DNA, 62 bp, Homo sapiens
tgctacaagcgaatgcttaaattaaaggttggagccagctttcaagtattgactatcgagca

SEQ ID NO: 5749 - DNA, 86 bp, Homo sapiens
gctcataaacttctcaatattccttggcctgaagctacacatgcttggtctcagcccaaagggaagttattttggaaagtttgagc

SEQ ID NO: 5750 - DNA, 79 bp, Homo sapiens
tagaacatgattctaaaagtattaaaacattgagttttaatcttcctctgtgtgatacttttgccattcatcttttctg

SEQ ID NO: 5751 - DNA, 79 bp, Homo sapiens
agggacaggatgcagaatggtaatgacattggggaagaaggctgaatccttctctttccttattccatatgcagtccct

SEQ ID NO: 5752 - DNA, 67 bp, Homo sapiens
atgagtacctatttcatgtggttatcatgaagaaactctgtcagaaaactaaaatgaaatggctcat

SEQ ID NO: 5753 - DNA, 83 bp, Homo sapiens
tattccaaaagcctctcggttagtttcagaagttaccagttaatgggcattaattgtaacaagaggctgagaagcacggaatg

SEQ ID NO: 5754 - DNA, 81 bp, Homo sapiens
gggatgcgggggtgggcacgagggagcgtctgagtgggaggattagggctcgcccgcctccttcccctcctcccgcgtccc

SEQ ID NO: 5755 - DNA, 61 bp, Homo sapiens
gacagaatgacatagtttgaacttaagcaggaggtcagcaggcagattgttttttgctgta

SEQ ID NO: 5756 - DNA, 83 bp, Homo sapiens
gcagtgacaggctggggttggatagagacctggttcttaaatagtcaggtaattaagatatctgaaccatccctgatcactgc

SEQ ID NO: 5757 - DNA, 60 bp, Homo sapiens
cacagcacacacaggctggaatcctgttgaagcagggtgagctgacctggctgagatgtc

SEQ ID NO: 5758 - DNA, 84 bp, Homo sapiens
cgctcattgtaaatttcagcgtcctccactctccttcagtaaactctgatttatgagggccaggatgcagacagacagtttgtg

SEQ ID NO: 5759 - DNA, 32 bp, Homo sapiens
  mature of SEQ ID 5105
tctcttagtctgtgctggtttcttaacagtgg

SEQ ID NO: 5760 - DNA, 17 bp, Homo sapiens
  mature of SEQ ID 5105
ccagatgttgaagtcag

SEQ ID NO: 5761 - DNA, 25 bp, Homo sapiens
  mature of SEQ ID 4947
aataggattttaaaagctaaatagg

SEQ ID NO: 5762 - DNA, 28 bp, Homo sapiens
  mature of SEQ ID 4947
gagcttttgtttgaattctctaatgtgg

SEQ ID NO: 5763 - DNA, 24 bp, Homo sapiens
  mature of SEQ ID 4173
gaacatggaggaaaagaagtaaga

SEQ ID NO: 5764 - DNA, 32 bp, Homo sapiens
  mature of SEQ ID 5733
acagacagtggggactctgttgagaggagctg

SEQ ID NO: 5765 - DNA, 30 bp, Homo sapiens
  mature of SEQ ID 4656
cggccgggcgagctgcactgaggaatgcgc

SEQ ID NO: 5766 - DNA, 33 bp, Homo sapiens
  mature of SEQ ID 4656
gggcgagctgcactgaggaatgcgccggggaag

SEQ ID NO: 5767 - DNA, 20 bp, Homo sapiens
  mature of SEQ ID 4656
ctgctccgacacgttctctg

SEQ ID NO: 5768 - DNA, 25 bp, Homo sapiens
  mature of SEQ ID 5054
ccacctgcttctcccctccttccac

SEQ ID NO: 5769 - DNA, 21 bp, Homo sapiens
  mature of SEQ ID 5054
gggggcaggttaatgcggtgg

SEQ ID NO: 5770 - DNA, 22 bp, Homo sapiens
  mature of SEQ ID 5166
ctgagataatgaaagcttgtca

SEQ ID NO: 5771 - DNA, 27 bp, Homo sapiens
  mature of SEQ ID 5166
gtgttaattgttgaccacttatctagg

SEQ ID NO: 5772 - DNA, 26 bp, Homo sapiens
  mature of SEQ ID 5364
aagagtgtgcttgatttgttctgcag

SEQ ID NO: 5773 - DNA, 18 bp, Homo sapiens
  mature of SEQ ID 5364
gttataaaaggttttact

SEQ ID NO: 5774 - DNA, 19 bp, Homo sapiens
  mature of SEQ ID 5490
ggaaccaaattgcagtttt

SEQ ID NO: 5775 - DNA, 20 bp, Homo sapiens
  mature of SEQ ID 4356
gcctcattagttgagaaatc

SEQ ID NO: 5776 - DNA, 22 bp, Homo sapiens
  mature of SEQ ID 4356
atttttcttttcctattgatgt

SEQ ID NO: 5777 - DNA, 19 bp, Homo sapiens
  mature of SEQ ID 5114
tttgagtaataagctacta

SEQ ID NO: 5778 - DNA, 27 bp, Homo sapiens
  mature of SEQ ID 5139
ctcctccatcttggcctcggcagtggc

SEQ ID NO: 5779 - DNA, 17 bp, Homo sapiens
  mature of SEQ ID 5139
ggatgtgccgccttctg

SEQ ID NO: 5780 - DNA, 21 bp, Homo sapiens
  mature of SEQ ID 5514
gggcagcagggtctgggagcg

SEQ ID NO: 5781 - DNA, 24 bp, Homo sapiens
  mature of SEQ ID 5514
cgggacctacccagccctctgccc

SEQ ID NO: 5782 - DNA, 34 bp, Homo sapiens
  mature of SEQ ID 4203
gtctccaaggccttgagtcaaataccctttatga

SEQ ID NO: 5783 - DNA, 30 bp, Homo sapiens
  mature of SEQ ID 4542
aacagctttaaaagtggcatttgcagagtg

SEQ ID NO: 5784 - DNA, 36 bp, Homo sapiens
  mature of SEQ ID 4542
cccaaagtgcaaatattgccataatttaacactgtt

SEQ ID NO: 5785 - DNA, 34 bp, Homo sapiens
  mature of SEQ ID 4542
gtactcattcccaaagtgcaaatattgccataat

SEQ ID NO: 5786 - DNA, 22 bp, Homo sapiens
  mature of SEQ ID 5515
caattatctgattagcaattta

SEQ ID NO: 5787 - DNA, 24 bp, Homo sapiens
  mature of SEQ ID 5515
tattcaaatgtagaatggctgcag

SEQ ID NO: 5788 - DNA, 28 bp, Homo sapiens
  mature of SEQ ID 5134
ggctgctgagcagtggcggcttctcatt

SEQ ID NO: 5789 - DNA, 21 bp, Homo sapiens
  mature of SEQ ID 4293
agggggtagaaaggaagaggg

SEQ ID NO: 5790 - DNA, 19 bp, Homo sapiens
  mature of SEQ ID 5624
tttacagtcttttaacctg

SEQ ID NO: 5791 - DNA, 22 bp, Homo sapiens
  mature of SEQ ID 5624
aagatgtgaaaccacgtttctt

SEQ ID NO: 5792 - DNA, 31 bp, Homo sapiens
  mature of SEQ ID 5148
gaagtcagcgactgatagctgtttgggtctc

SEQ ID NO: 5793 - DNA, 35 bp, Homo sapiens
  mature of SEQ ID 5630
ctggcatgttataaagctaatttgtttatagttgt

SEQ ID NO: 5794 - DNA, 35 bp, Homo sapiens
  mature of SEQ ID 5630
taatgcttgactggcatgttataaagctaatttgt

SEQ ID NO: 5795 - DNA, 26 bp, Homo sapiens
  mature of SEQ ID 5630
ataaagctaatttgtttatagttgtg

SEQ ID NO: 5796 - DNA, 23 bp, Homo sapiens
  mature of SEQ ID 5630
cataattatacactctgtacata

SEQ ID NO: 5797 - DNA, 20 bp, Homo sapiens
  mature of SEQ ID 5111
cctggaaccttcactaacca

SEQ ID NO: 5798 - DNA, 17 bp, Homo sapiens
  mature of SEQ ID 5111
actgaccccagggctga

SEQ ID NO: 5799 - DNA, 19 bp, Homo sapiens
  mature of SEQ ID 4364
gactggtgatcatcgagaa

SEQ ID NO: 5800 - DNA, 28 bp, Homo sapiens
  mature of SEQ ID 5004
aatgagtatgtgtaaaaattgtcctcag

SEQ ID NO: 5801 - DNA, 24 bp, Homo sapiens
  mature of SEQ ID 4443
aaggctttagggatttggggaggt

SEQ ID NO: 5802 - DNA, 18 bp, Homo sapiens
  mature of SEQ ID 4443
caatattccttcttcaaa

SEQ ID NO: 5803 - DNA, 27 bp, Homo sapiens
  mature of SEQ ID 4436
agtcctacacaaaccctctgttgctct

SEQ ID NO: 5804 - DNA, 32 bp, Homo sapiens
  mature of SEQ ID 4436
agaccatgctaaccaattctgagggctgtgag

SEQ ID NO: 5805 - DNA, 34 bp, Homo sapiens
  mature of SEQ ID 4436
gctaaccaattctgagggctgtgaggggtaggtg

SEQ ID NO: 5806 - DNA, 19 bp, Homo sapiens
  mature of SEQ ID 5247
aaaattccttctgagatta

SEQ ID NO: 5807 - DNA, 17 bp, Homo sapiens
  mature of SEQ ID 5247
gtcatcctaattccttt

SEQ ID NO: 5808 - DNA, 31 bp, Homo sapiens
  mature of SEQ ID 5607
gtcatctgttatttagttgtcattatgaact

SEQ ID NO: 5809 - DNA, 34 bp, Homo sapiens
  mature of SEQ ID 5607
tgttatttagttgtcattatgaactttttgggtt

SEQ ID NO: 5810 - DNA, 25 bp, Homo sapiens
  mature of SEQ ID 4352
ccctgcccctgggtctccaggcaac

SEQ ID NO: 5811 - DNA, 23 bp, Homo sapiens
  mature of SEQ ID 5513
aagactggatgggcctgcttggg

SEQ ID NO: 5812 - DNA, 18 bp, Homo sapiens
  mature of SEQ ID 4760
tctttaggtaatctaaat

SEQ ID NO: 5813 - DNA, 19 bp, Homo sapiens
  mature of SEQ ID 4760
gtgtatctcaaatttagaa

SEQ ID NO: 5814 - DNA, 33 bp, Homo sapiens
  mature of SEQ ID 4989
cctggaaccttcactaaccagatccaggcagcc

SEQ ID NO: 5815 - DNA, 30 bp, Homo sapiens
  mature of SEQ ID 5244
ggtaatccctaatctactagtctgtttgtt

SEQ ID NO: 5816 - DNA, 31 bp, Homo sapiens
  mature of SEQ ID 5244
gataagtaggctggttgattaggatgaatcc

SEQ ID NO: 5817 - DNA, 18 bp, Homo sapiens
  mature of SEQ ID 4994
ggcagttgctgcagggca

SEQ ID NO: 5818 - DNA, 30 bp, Homo sapiens
  mature of SEQ ID 4994
gtgttctgcatgtctgattccgttgcgctg

SEQ ID NO: 5819 - DNA, 33 bp, Homo sapiens
  mature of SEQ ID 4781
ggtcatggcctatgatcgttatgtagccatctg

SEQ ID NO: 5820 - DNA, 30 bp, Homo sapiens
  mature of SEQ ID 4781
ttcatggtcatggcctatgatcgttatgta

SEQ ID NO: 5821 - DNA, 29 bp, Homo sapiens
  mature of SEQ ID 4738
gcatgatttttattagccttgcaatttct

SEQ ID NO: 5822 - DNA, 32 bp, Homo sapiens
  mature of SEQ ID 4738
gatttttattagccttgcaatttcttaatggg

SEQ ID NO: 5823 - DNA, 21 bp, Homo sapiens
  mature of SEQ ID 4982
ggatttcatcagaaatgtgta

SEQ ID NO: 5824 - DNA, 17 bp, Homo sapiens
  mature of SEQ ID 4982
ttctcaagatgaaattt

SEQ ID NO: 5825 - DNA, 30 bp, Homo sapiens
  mature of SEQ ID 4071
tgactatgaataaatgtttcagctattgag

SEQ ID NO: 5826 - DNA, 29 bp, Homo sapiens
  mature of SEQ ID 5609
tatgttgtagccacagctggagcctgggt

SEQ ID NO: 5827 - DNA, 25 bp, Homo sapiens
  mature of SEQ ID 5426
tggcactgtttccatttccacatcc

SEQ ID NO: 5828 - DNA, 18 bp, Homo sapiens
  mature of SEQ ID 5426
aagaatggggtataatgc

SEQ ID NO: 5829 - DNA, 22 bp, Homo sapiens
  mature of SEQ ID 4703
agtaaacataagcttaaatgtt

SEQ ID NO: 5830 - DNA, 25 bp, Homo sapiens
  mature of SEQ ID 4703
ttaatagggtagatttaagtcgatg

SEQ ID NO: 5831 - DNA, 23 bp, Homo sapiens
  mature of SEQ ID 4813
ttttgtttaattgtcctttgaat

SEQ ID NO: 5832 - DNA, 27 bp, Homo sapiens
  mature of SEQ ID 4813
tccaatggcaattgaatagtgcagctg

SEQ ID NO: 5833 - DNA, 28 bp, Homo sapiens
  mature of SEQ ID 4110
tattttaagtacacgaaaagttgagtgg

SEQ ID NO: 5834 - DNA, 30 bp, Homo sapiens
  mature of SEQ ID 4110
gactttcactcactttaatatactgtcaaa

SEQ ID NO: 5835 - DNA, 22 bp, Homo sapiens
  mature of SEQ ID 4235
tattgttaacttctttttgcga

SEQ ID NO: 5836 - DNA, 18 bp, Homo sapiens
  mature of SEQ ID 4235
ttgattattctcgtgtta

SEQ ID NO: 5837 - DNA, 33 bp, Homo sapiens
  mature of SEQ ID 4235
ttgtaaagcagttagttgctgcacatggataac

SEQ ID NO: 5838 - DNA, 26 bp, Homo sapiens
  mature of SEQ ID 4332
cattaattatatatgtcattattgta

SEQ ID NO: 5839 - DNA, 32 bp, Homo sapiens
  mature of SEQ ID 5545
gcctggatggccacgtatatggctggggtgtg

SEQ ID NO: 5840 - DNA, 30 bp, Homo sapiens
  mature of SEQ ID 5545
gcacggcctggatggccacgtatatggctg

SEQ ID NO: 5841 - DNA, 17 bp, Homo sapiens
  mature of SEQ ID 5545
gagtccatcacaatgcc

SEQ ID NO: 5842 - DNA, 25 bp, Homo sapiens
  mature of SEQ ID 5584
caagccgggaggctgcatcgctaat

SEQ ID NO: 5843 - DNA, 23 bp, Homo sapiens
  mature of SEQ ID 4302
taacagtggacccatgtaatact

SEQ ID NO: 5844 - DNA, 28 bp, Homo sapiens
  mature of SEQ ID 4675
tgctgcatcataccgactggggggagga

SEQ ID NO: 5845 - DNA, 25 bp, Homo sapiens
  mature of SEQ ID 4675
cggctcttcccccgtccctgcggca

SEQ ID NO: 5846 - DNA, 25 bp, Homo sapiens
  mature of SEQ ID 5212
tggctggtaggtcagtccccatcct

SEQ ID NO: 5847 - DNA, 34 bp, Homo sapiens
  mature of SEQ ID 5212
atctcgaagtgcccactctagtccgctccagtag

SEQ ID NO: 5848 - DNA, 31 bp, Homo sapiens
  mature of SEQ ID 5212
aggaggatctcgaagtgcccactctagtccg

SEQ ID NO: 5849 - DNA, 27 bp, Homo sapiens
  mature of SEQ ID 5289
taatgaaggatgccggtaaacagaaat

SEQ ID NO: 5850 - DNA, 33 bp, Homo sapiens
  mature of SEQ ID 5289
atttctgcaactgggaaattctgtatattatgt

SEQ ID NO: 5851 - DNA, 22 bp, Homo sapiens
  mature of SEQ ID 5352
tgtttgtagaacttcatgcctt

SEQ ID NO: 5852 - DNA, 29 bp, Homo sapiens
  mature of SEQ ID 5138
cactagattgtgaagactggggtggacct

SEQ ID NO: 5853 - DNA, 31 bp, Homo sapiens
  mature of SEQ ID 4583
ggagcaaagctttaatggggtctcagcttga

SEQ ID NO: 5854 - DNA, 31 bp, Homo sapiens
  mature of SEQ ID 5573
gggaatctcacccctcatttcaaattcatgg

SEQ ID NO: 5855 - DNA, 17 bp, Homo sapiens
  mature of SEQ ID 4752
gcagtggcctaatagtc

SEQ ID NO: 5856 - DNA, 31 bp, Homo sapiens
  mature of SEQ ID 4752
ggcttttatttgggaatttgtcaaggtttca

SEQ ID NO: 5857 - DNA, 29 bp, Homo sapiens
  mature of SEQ ID 4752
ttatggcttttatttgggaatttgtcaag

SEQ ID NO: 5858 - DNA, 25 bp, Homo sapiens
  mature of SEQ ID 4038
gtctgaatctctttgctgagcccag

SEQ ID NO: 5859 - DNA, 30 bp, Homo sapiens
  mature of SEQ ID 4918
tccccaaaggggtcttcctctgaaatgtct

SEQ ID NO: 5860 - DNA, 21 bp, Homo sapiens
  mature of SEQ ID 5703
tgcacaattttattcatatga

SEQ ID NO: 5861 - DNA, 17 bp, Homo sapiens
  mature of SEQ ID 5703
aaagggaggaaaaattt

SEQ ID NO: 5862 - DNA, 24 bp, Homo sapiens
  mature of SEQ ID 4717
ggaacagattagaaaagtccgtct

SEQ ID NO: 5863 - DNA, 25 bp, Homo sapiens
  mature of SEQ ID 4717
tcttgagtggacatgactgtattcc

SEQ ID NO: 5864 - DNA, 31 bp, Homo sapiens
  mature of SEQ ID 4279
ggttaaacagtgtatgtcattggcttgggtt

SEQ ID NO: 5865 - DNA, 24 bp, Homo sapiens
  mature of SEQ ID 5019
gggaacacatttgagtatgtctgt

SEQ ID NO: 5866 - DNA, 20 bp, Homo sapiens
  mature of SEQ ID 5019
ctgcaaaagtgcttatatgc

SEQ ID NO: 5867 - DNA, 34 bp, Homo sapiens
  mature of SEQ ID 5049
gactggcccgccccttgggggattccctccgctc

SEQ ID NO: 5868 - DNA, 23 bp, Homo sapiens
  mature of SEQ ID 5049
gaggggagggctcctggggccag

SEQ ID NO: 5869 - DNA, 17 bp, Homo sapiens
  mature of SEQ ID 4784
tgcctgccagctcctgg

SEQ ID NO: 5870 - DNA, 23 bp, Homo sapiens
  mature of SEQ ID 4784
tcagcagctggcacgggattttt

SEQ ID NO: 5871 - DNA, 33 bp, Homo sapiens
  mature of SEQ ID 4109
aagtgatgaattgatcagatagacgaggccggg

SEQ ID NO: 5872 - DNA, 31 bp, Homo sapiens
  mature of SEQ ID 4109
gctcagaagtgatgaattgatcagatagacg

SEQ ID NO: 5873 - DNA, 17 bp, Homo sapiens
  mature of SEQ ID 4109
gcgattctgatctgggc

SEQ ID NO: 5874 - DNA, 19 bp, Homo sapiens
  mature of SEQ ID 4109
cccggccactgattatcga

SEQ ID NO: 5875 - DNA, 19 bp, Homo sapiens
  mature of SEQ ID 4472
tccccctagatgcaccctc

SEQ ID NO: 5876 - DNA, 34 bp, Homo sapiens
  mature of SEQ ID 4472
gtcttggaggggagggaggagggagaccggtagg

SEQ ID NO: 5877 - DNA, 31 bp, Homo sapiens
  mature of SEQ ID 5245
ccgggaggcgctgccgagcagcagccccagc

SEQ ID NO: 5878 - DNA, 18 bp, Homo sapiens
  mature of SEQ ID 5245
gctggggggctccggcgg

SEQ ID NO: 5879 - DNA, 32 bp, Homo sapiens
  mature of SEQ ID 5089
acgaaggacaacacggtgtacttgctggtctt

SEQ ID NO: 5880 - DNA, 29 bp, Homo sapiens
  mature of SEQ ID 5089
caaaatagagattggcaaaccggtgtagc

SEQ ID NO: 5881 - DNA, 32 bp, Homo sapiens
  mature of SEQ ID 5089
atagagattggcaaaccggtgtagctgctcaa

SEQ ID NO: 5882 - DNA, 19 bp, Homo sapiens
  mature of SEQ ID 4054
cttatattcattaaaatta

SEQ ID NO: 5883 - DNA, 23 bp, Homo sapiens
  mature of SEQ ID 4054
tatttttgttgttttatttttaa

SEQ ID NO: 5884 - DNA, 25 bp, Homo sapiens
  mature of SEQ ID 5405
ttgtgacagtgtttgctggatgccg

SEQ ID NO: 5885 - DNA, 18 bp, Homo sapiens
  mature of SEQ ID 5405
agtttagtttgcactgtt

SEQ ID NO: 5886 - DNA, 17 bp, Homo sapiens
  mature of SEQ ID 4342
atggcccccaagtcccg

SEQ ID NO: 5887 - DNA, 29 bp, Homo sapiens
  mature of SEQ ID 4342
cctctgcgtggtgggactcttctttggca

SEQ ID NO: 5888 - DNA, 32 bp, Homo sapiens
  mature of SEQ ID 4342
tgcgtggtgggactcttctttggcagtgccat

SEQ ID NO: 5889 - DNA, 20 bp, Homo sapiens
  mature of SEQ ID 5317
ataatattggctttatgaga

SEQ ID NO: 5890 - DNA, 30 bp, Homo sapiens
  mature of SEQ ID 5317
tctcataaagttagattttgtacattagtg

SEQ ID NO: 5891 - DNA, 27 bp, Homo sapiens
  mature of SEQ ID 4425
agaatcggagtcagatgtgtctctgta

SEQ ID NO: 5892 - DNA, 20 bp, Homo sapiens
  mature of SEQ ID 4425
tgaggcgcgactccttttct

SEQ ID NO: 5893 - DNA, 29 bp, Homo sapiens
  mature of SEQ ID 5602
tgataattgagcaattaacttgaaattac

SEQ ID NO: 5894 - DNA, 31 bp, Homo sapiens
  mature of SEQ ID 5602
aattgagcaattaacttgaaattaccaaatg

SEQ ID NO: 5895 - DNA, 22 bp, Homo sapiens
  mature of SEQ ID 5602
ttccaccgcgcatgtttcaaat

SEQ ID NO: 5896 - DNA, 26 bp, Homo sapiens
  mature of SEQ ID 5090
caatgaagaatgtgaacaacttgatt

SEQ ID NO: 5897 - DNA, 28 bp, Homo sapiens
  mature of SEQ ID 4343
gaaaccatcagtgtatttggttactgtg

SEQ ID NO: 5898 - DNA, 27 bp, Homo sapiens
  mature of SEQ ID 4640
ctcttaatcctgtccttttaactctgt

SEQ ID NO: 5899 - DNA, 30 bp, Homo sapiens
  mature of SEQ ID 4640
ttaagagtgaagtgagacaggaatgatgag

SEQ ID NO: 5900 - DNA, 29 bp, Homo sapiens
  mature of SEQ ID 4204
cagaggtaagggtaggtaggtgaactggg

SEQ ID NO: 5901 - DNA, 31 bp, Homo sapiens
  mature of SEQ ID 4204
ggtaagggtaggtaggtgaactgggatgcta

SEQ ID NO: 5902 - DNA, 23 bp, Homo sapiens
  mature of SEQ ID 4204
tggtgtcctagacagatttcact

SEQ ID NO: 5903 - DNA, 27 bp, Homo sapiens
  mature of SEQ ID 4628
cccactgcccctttgttttcctcctct

SEQ ID NO: 5904 - DNA, 20 bp, Homo sapiens
  mature of SEQ ID 4227
ggcggcgcgcgtgtggccga

SEQ ID NO: 5905 - DNA, 21 bp, Homo sapiens
  mature of SEQ ID 4227
tgtatgtgtgcgcctgtcagt

SEQ ID NO: 5906 - DNA, 20 bp, Homo sapiens
  mature of SEQ ID 4367
cgggaggtcggcccgccccc

SEQ ID NO: 5907 - DNA, 23 bp, Homo sapiens
  mature of SEQ ID 5704
catttaaataattccttttgttc

SEQ ID NO: 5908 - DNA, 18 bp, Homo sapiens
  mature of SEQ ID 5704
ctgaaaaatatgtcatgg

SEQ ID NO: 5909 - DNA, 22 bp, Homo sapiens
  mature of SEQ ID 4391
catatgtatgagacacattttt

SEQ ID NO: 5910 - DNA, 24 bp, Homo sapiens
  mature of SEQ ID 4391
tcatacacaaatttagaaatgcat

SEQ ID NO: 5911 - DNA, 20 bp, Homo sapiens
  mature of SEQ ID 5508
agctgacaactgtgaagttg

SEQ ID NO: 5912 - DNA, 17 bp, Homo sapiens
  mature of SEQ ID 5508
caatgaatttgtcatgc

SEQ ID NO: 5913 - DNA, 32 bp, Homo sapiens
  mature of SEQ ID 4920
gggagatggcctctcaaagctgaaggtcagga

SEQ ID NO: 5914 - DNA, 34 bp, Homo sapiens
  mature of SEQ ID 4783
tggcaggccagttggctcctctctccacctgcct

SEQ ID NO: 5915 - DNA, 31 bp, Homo sapiens
  mature of SEQ ID 4783
aggccctggcaggccagttggctcctctctc

SEQ ID NO: 5916 - DNA, 33 bp, Homo sapiens
  mature of SEQ ID 4359
tatgaactgcttaggtagtaagcagttattcct

SEQ ID NO: 5917 - DNA, 31 bp, Homo sapiens
  mature of SEQ ID 5005
ggtcatcccccacaatctggatgtccacccc

SEQ ID NO: 5918 - DNA, 24 bp, Homo sapiens
  mature of SEQ ID 5005
ctgggcaatcctcttggggttggt

SEQ ID NO: 5919 - DNA, 18 bp, Homo sapiens
  mature of SEQ ID 5680
ttgtttttgaaactagtt

SEQ ID NO: 5920 - DNA, 17 bp, Homo sapiens
  mature of SEQ ID 5680
agaatttttattgagat

SEQ ID NO: 5921 - DNA, 30 bp, Homo sapiens
  mature of SEQ ID 5680
gttttaaattttagagtcacattttattct

SEQ ID NO: 5922 - DNA, 29 bp, Homo sapiens
  mature of SEQ ID 5196
ttttggaataattttctcttttcatcttt

SEQ ID NO: 5923 - DNA, 17 bp, Homo sapiens
  mature of SEQ ID 5196
tgaaggaaactgaaagg

SEQ ID NO: 5924 - DNA, 25 bp, Homo sapiens
  mature of SEQ ID 5221
cgcagcgcgcccgccaccccgcggg

SEQ ID NO: 5925 - DNA, 22 bp, Homo sapiens
  mature of SEQ ID 5221
ctccggggtggcgggcaccgtg

SEQ ID NO: 5926 - DNA, 17 bp, Homo sapiens
  mature of SEQ ID 4818
gggagcctggcccacag

SEQ ID NO: 5927 - DNA, 18 bp, Homo sapiens
  mature of SEQ ID 4818
gggccaacgttttgggct

SEQ ID NO: 5928 - DNA, 22 bp, Homo sapiens
  mature of SEQ ID 5348
ccaaagcactcaatttctaagc

SEQ ID NO: 5929 - DNA, 24 bp, Homo sapiens
  mature of SEQ ID 5635
tctcagaaagttattaaagtgatg

SEQ ID NO: 5930 - DNA, 17 bp, Homo sapiens
  mature of SEQ ID 5635
attctcattctatttgt

SEQ ID NO: 5931 - DNA, 36 bp, Homo sapiens
  mature of SEQ ID 5110
agactctcctatcagcagcgcttcgaggataaaagc

SEQ ID NO: 5932 - DNA, 34 bp, Homo sapiens
  mature of SEQ ID 5110
gcatttttcagactctcctatcagcagcgcttcg

SEQ ID NO: 5933 - DNA, 29 bp, Homo sapiens
  mature of SEQ ID 5053
ttgtagctgctatttatagcaatatcagc

SEQ ID NO: 5934 - DNA, 32 bp, Homo sapiens
  mature of SEQ ID 5053
agctgctatttatagcaatatcagcattcaag

SEQ ID NO: 5935 - DNA, 26 bp, Homo sapiens
  mature of SEQ ID 5053
aatagcaaagtgaagctactggtata

SEQ ID NO: 5936 - DNA, 26 bp, Homo sapiens
  mature of SEQ ID 4183
gcatggcagtttaagcgagacagttt

SEQ ID NO: 5937 - DNA, 17 bp, Homo sapiens
  mature of SEQ ID 4183
tcagaaaagagactgat

SEQ ID NO: 5938 - DNA, 30 bp, Homo sapiens
  mature of SEQ ID 5550
actgtgaatgggttatttttagggaaagct

SEQ ID NO: 5939 - DNA, 32 bp, Homo sapiens
  mature of SEQ ID 4199
taatgatgttatctaggcaccattggagactg

SEQ ID NO: 5940 - DNA, 30 bp, Homo sapiens
  mature of SEQ ID 4199
ttgcctaatgatgttatctaggcaccattg

SEQ ID NO: 5941 - DNA, 19 bp, Homo sapiens
  mature of SEQ ID 4199
tttttaggattctgcatag

SEQ ID NO: 5942 - DNA, 26 bp, Homo sapiens
  mature of SEQ ID 5603
caacacagtgtggctggcgggaggct

SEQ ID NO: 5943 - DNA, 17 bp, Homo sapiens
  mature of SEQ ID 5603
ggcatgcacatgcgcgg

SEQ ID NO: 5944 - DNA, 32 bp, Homo sapiens
  mature of SEQ ID 4520
ggaggactcgtgggccatggccttgtagagct

SEQ ID NO: 5945 - DNA, 31 bp, Homo sapiens
  mature of SEQ ID 4884
ggcctttgtagacaccccatgtggagctagt

SEQ ID NO: 5946 - DNA, 34 bp, Homo sapiens
  mature of SEQ ID 4884
tgtagacaccccatgtggagctagtctgaaaact

SEQ ID NO: 5947 - DNA, 21 bp, Homo sapiens
  mature of SEQ ID 4884
atgtcctggggatgagctgca

SEQ ID NO: 5948 - DNA, 29 bp, Homo sapiens
  mature of SEQ ID 5023
ttggacgcagctggagcacaggccctgtt

SEQ ID NO: 5949 - DNA, 22 bp, Homo sapiens
  mature of SEQ ID 4271
aaaaggaaaatcatgaaaagag

SEQ ID NO: 5950 - DNA, 23 bp, Homo sapiens
  mature of SEQ ID 5257
gcctcggcccaggggcgagtatc

SEQ ID NO: 5951 - DNA, 33 bp, Homo sapiens
  mature of SEQ ID 5257
gtccccgacaccgagacagccagccctctcccc

SEQ ID NO: 5952 - DNA, 36 bp, Homo sapiens
  mature of SEQ ID 5257
caccgagacagccagccctctcccctgcctcgcggc

SEQ ID NO: 5953 - DNA, 17 bp, Homo sapiens
  mature of SEQ ID 5257
gttgctgtgtcggagac

SEQ ID NO: 5954 - DNA, 34 bp, Homo sapiens
  mature of SEQ ID 4519
ctgtagtcaggctgcataaatattcctgagcttt

SEQ ID NO: 5955 - DNA, 31 bp, Homo sapiens
  mature of SEQ ID 4519
ccaaactctcctgagaatagcataggcagta

SEQ ID NO: 5956 - DNA, 33 bp, Homo sapiens
  mature of SEQ ID 4519
tctcctgagaatagcataggcagtagattgcag

SEQ ID NO: 5957 - DNA, 29 bp, Homo sapiens
  mature of SEQ ID 4765
aaatgagtatgaatcatcaatatgtaaac

SEQ ID NO: 5958 - DNA, 31 bp, Homo sapiens
  mature of SEQ ID 4765
gagtatgaatcatcaatatgtaaacacagtc

SEQ ID NO: 5959 - DNA, 21 bp, Homo sapiens
  mature of SEQ ID 4765
tgagtcactgttgatgaacaa

SEQ ID NO: 5960 - DNA, 34 bp, Homo sapiens
  mature of SEQ ID 5020
agcggccgaggcgcggcccgtgcgccctgagcgc

SEQ ID NO: 5961 - DNA, 17 bp, Homo sapiens
  mature of SEQ ID 5172
ccaaggccacagaagtt

SEQ ID NO: 5962 - DNA, 24 bp, Homo sapiens
  mature of SEQ ID 4683
attttaatgagagagacactgggg

SEQ ID NO: 5963 - DNA, 34 bp, Homo sapiens
  mature of SEQ ID 5724
ctggaaaatgatagatgcctaaaattgatcaggg

SEQ ID NO: 5964 - DNA, 36 bp, Homo sapiens
  mature of SEQ ID 5724
gatagatgcctaaaattgatcagggtaatcgatgct

SEQ ID NO: 5965 - DNA, 23 bp, Homo sapiens
  mature of SEQ ID 5724
gatggatgtatcatctgccagat

SEQ ID NO: 5966 - DNA, 32 bp, Homo sapiens
  mature of SEQ ID 4270
gcccaggagcagccagagagcaatgaaaagaa

SEQ ID NO: 5967 - DNA, 29 bp, Homo sapiens
  mature of SEQ ID 4270
ttcagcccaggagcagccagagagcaatg

SEQ ID NO: 5968 - DNA, 21 bp, Homo sapiens
  mature of SEQ ID 4974
ttcaatgtggtgctgattcag

SEQ ID NO: 5969 - DNA, 32 bp, Homo sapiens
  mature of SEQ ID 4974
tgtgaaagctatttatgtcccggcaccatttg

SEQ ID NO: 5970 - DNA, 30 bp, Homo sapiens
  mature of SEQ ID 4974
tcttctgtgaaagctatttatgtcccggca

SEQ ID NO: 5971 - DNA, 17 bp, Homo sapiens
  mature of SEQ ID 4040
gggaacatacatcatgc

SEQ ID NO: 5972 - DNA, 26 bp, Homo sapiens
  mature of SEQ ID 4040
ctactcagacgcactgactgttgttt

SEQ ID NO: 5973 - DNA, 28 bp, Homo sapiens
  mature of SEQ ID 5276
aaatgtgtatatttcagaacttctttgg

SEQ ID NO: 5974 - DNA, 22 bp, Homo sapiens
  mature of SEQ ID 5276
tgggaaaattctgtaaacatgt

SEQ ID NO: 5975 - DNA, 24 bp, Homo sapiens
  mature of SEQ ID 4565
cttaaaatgtgatgtctgaaaata

SEQ ID NO: 5976 - DNA, 22 bp, Homo sapiens
  mature of SEQ ID 4565
agctttattattagttttgagc

SEQ ID NO: 5977 - DNA, 32 bp, Homo sapiens
  mature of SEQ ID 5437
tggggaattatgtaaattctttatatgaaact

SEQ ID NO: 5978 - DNA, 29 bp, Homo sapiens
  mature of SEQ ID 5437
gtattggggaattatgtaaattctttata

SEQ ID NO: 5979 - DNA, 24 bp, Homo sapiens
  mature of SEQ ID 5423
gttatatttgcctttggaatgtat

SEQ ID NO: 5980 - DNA, 33 bp, Homo sapiens
  mature of SEQ ID 4591
gaaaaatggtaagagtatgtggtgggaggctga

SEQ ID NO: 5981 - DNA, 32 bp, Homo sapiens
  mature of SEQ ID 4591
gtcttcccttttttatttattgctgtgttctt

SEQ ID NO: 5982 - DNA, 29 bp, Homo sapiens
  mature of SEQ ID 4440
gtcctggcccactatgccagcatctgcca

SEQ ID NO: 5983 - DNA, 27 bp, Homo sapiens
  mature of SEQ ID 4440
tggcattgtgctcatcgtggagcctga

SEQ ID NO: 5984 - DNA, 22 bp, Homo sapiens
  mature of SEQ ID 4623
taaagttaaaagaaaatctagt

SEQ ID NO: 5985 - DNA, 27 bp, Homo sapiens
  mature of SEQ ID 4623
gcttgacaacatatttagaattttctg

SEQ ID NO: 5986 - DNA, 18 bp, Homo sapiens
  mature of SEQ ID 4863
gagtaaaccatgccagca

SEQ ID NO: 5987 - DNA, 26 bp, Homo sapiens
  mature of SEQ ID 5417
ctccctggccatatggctcagggcct

SEQ ID NO: 5988 - DNA, 23 bp, Homo sapiens
  mature of SEQ ID 5417
ccggggatggcatttgggaagct

SEQ ID NO: 5989 - DNA, 25 bp, Homo sapiens
  mature of SEQ ID 4600
gttttatgcttattttattattact

SEQ ID NO: 5990 - DNA, 34 bp, Homo sapiens
  mature of SEQ ID 4600
atggaaaaataaagtgaaattgccctaataaaac

SEQ ID NO: 5991 - DNA, 32 bp, Homo sapiens
  mature of SEQ ID 4600
ttgctgtatggaaaaataaagtgaaattgccc

SEQ ID NO: 5992 - DNA, 34 bp, Homo sapiens
  mature of SEQ ID 5439
gggaggccagcaagggaggatggctgcaggttga

SEQ ID NO: 5993 - DNA, 29 bp, Homo sapiens
  mature of SEQ ID 5439
tcaatatgtaatattttctatggtctcct

SEQ ID NO: 5994 - DNA, 21 bp, Homo sapiens
  mature of SEQ ID 4629
attctgctctaattgagttaa

SEQ ID NO: 5995 - DNA, 22 bp, Homo sapiens
  mature of SEQ ID 5605
ccattctctggatgctgaatgt

SEQ ID NO: 5996 - DNA, 27 bp, Homo sapiens
  mature of SEQ ID 5350
actttcaaaaattcaactacctagaaa

SEQ ID NO: 5997 - DNA, 29 bp, Homo sapiens
  mature of SEQ ID 5313
tccaagaaggaatagtacatatattgaaa

SEQ ID NO: 5998 - DNA, 32 bp, Homo sapiens
  mature of SEQ ID 5313
agaaggaatagtacatatattgaaattttact

SEQ ID NO: 5999 - DNA, 26 bp, Homo sapiens
  mature of SEQ ID 5313
agaatcaaatgtatgaacttctttga

SEQ ID NO: 6000 - DNA, 31 bp, Homo sapiens
  mature of SEQ ID 4155
ggtccattttaatcacaagccagctggtctg

SEQ ID NO: 6001 - DNA, 33 bp, Homo sapiens
  mature of SEQ ID 4155
ttttaatcacaagccagctggtctgagggcacg

SEQ ID NO: 6002 - DNA, 30 bp, Homo sapiens
  mature of SEQ ID 4308
agaagaaagtgaagctggggactgaggtgg

SEQ ID NO: 6003 - DNA, 20 bp, Homo sapiens
  mature of SEQ ID 4308
ctccccagcttgctacttct

SEQ ID NO: 6004 - DNA, 27 bp, Homo sapiens
  mature of SEQ ID 5345
acagtgttgagactttgtgttgaattt

SEQ ID NO: 6005 - DNA, 28 bp, Homo sapiens
  mature of SEQ ID 5345
aaattcacaataaagtttcagaaattgt

SEQ ID NO: 6006 - DNA, 19 bp, Homo sapiens
  mature of SEQ ID 4445
cctccctctcctggccagg

SEQ ID NO: 6007 - DNA, 24 bp, Homo sapiens
  mature of SEQ ID 4451
agcagtgaatagtaccctggtggc

SEQ ID NO: 6008 - DNA, 32 bp, Homo sapiens
  mature of SEQ ID 4451
gtcaccagggtaccatttggtaaattgctgct

SEQ ID NO: 6009 - DNA, 17 bp, Homo sapiens
  mature of SEQ ID 4828
ctgtgggtggctgggca

SEQ ID NO: 6010 - DNA, 20 bp, Homo sapiens
  mature of SEQ ID 4828
cctgcccgcacccgcccact

SEQ ID NO: 6011 - DNA, 26 bp, Homo sapiens
  mature of SEQ ID 5478
cagtgtgaattagttgattagcttgc

SEQ ID NO: 6012 - DNA, 27 bp, Homo sapiens
  mature of SEQ ID 5478
tacagcaagttattatttgccattgac

SEQ ID NO: 6013 - DNA, 28 bp, Homo sapiens
  mature of SEQ ID 4795
agacctgtgcagtcacatgtctactgtt

SEQ ID NO: 6014 - DNA, 29 bp, Homo sapiens
  mature of SEQ ID 4795
aacgggggacactggttgccatagtgact

SEQ ID NO: 6015 - DNA, 28 bp, Homo sapiens
  mature of SEQ ID 5722
ggcattgttatgatatattactttaata

SEQ ID NO: 6016 - DNA, 30 bp, Homo sapiens
  mature of SEQ ID 4251
agatcctctttctctctcccccgcccctgc

SEQ ID NO: 6017 - DNA, 22 bp, Homo sapiens
  mature of SEQ ID 4251
gggtgggggtggggaagagggc

SEQ ID NO: 6018 - DNA, 21 bp, Homo sapiens
  mature of SEQ ID 5338
gcaggccaggttgcaggttga

SEQ ID NO: 6019 - DNA, 23 bp, Homo sapiens
  mature of SEQ ID 5338
ttaacttgagctgagtttgcagc

SEQ ID NO: 6020 - DNA, 20 bp, Homo sapiens
  mature of SEQ ID 4759
tgttagtgctgggccatcaa

SEQ ID NO: 6021 - DNA, 23 bp, Homo sapiens
  mature of SEQ ID 4759
attgatgctgtctggtcatgtct

SEQ ID NO: 6022 - DNA, 26 bp, Homo sapiens
  mature of SEQ ID 4515
tgatgaggctcagtaatcttaatgag

SEQ ID NO: 6023 - DNA, 22 bp, Homo sapiens
  mature of SEQ ID 4515
tattaccttgggcctaacatta

SEQ ID NO: 6024 - DNA, 24 bp, Homo sapiens
  mature of SEQ ID 5731
gccaccgggatggacatgtggagc

SEQ ID NO: 6025 - DNA, 17 bp, Homo sapiens
  mature of SEQ ID 4140
gttattgttgtagtgag

SEQ ID NO: 6026 - DNA, 22 bp, Homo sapiens
  mature of SEQ ID 5396
attttaggatccttttgacatt

SEQ ID NO: 6027 - DNA, 20 bp, Homo sapiens
  mature of SEQ ID 5396
gttgaggagtttgttaaaat

SEQ ID NO: 6028 - DNA, 18 bp, Homo sapiens
  mature of SEQ ID 4707
caaagagaggtccatggg

SEQ ID NO: 6029 - DNA, 19 bp, Homo sapiens
  mature of SEQ ID 4707
gtcctgagcaagatgagaa

SEQ ID NO: 6030 - DNA, 30 bp, Homo sapiens
  mature of SEQ ID 4131
gggtgaatggatttatttattcatgaataa

SEQ ID NO: 6031 - DNA, 21 bp, Homo sapiens
  mature of SEQ ID 4266
atggcctgttttgtttgcaga

SEQ ID NO: 6032 - DNA, 24 bp, Homo sapiens
  mature of SEQ ID 4266
gctttccaatgcgacctgtcatcc

SEQ ID NO: 6033 - DNA, 32 bp, Homo sapiens
  mature of SEQ ID 4135
ctgtgtgtttcacagcttccttgggagccgct

SEQ ID NO: 6034 - DNA, 29 bp, Homo sapiens
  mature of SEQ ID 4135
gcacctgtgtgtttcacagcttccttggg

SEQ ID NO: 6035 - DNA, 29 bp, Homo sapiens
  mature of SEQ ID 4291
gagtcggcttccgcctcgtccagcggctc

SEQ ID NO: 6036 - DNA, 27 bp, Homo sapiens
  mature of SEQ ID 5586
ctattgtgcagccttttactaacactc

SEQ ID NO: 6037 - DNA, 24 bp, Homo sapiens
  mature of SEQ ID 5586
tgagagaggaatgtgaataaaagg

SEQ ID NO: 6038 - DNA, 27 bp, Homo sapiens
  mature of SEQ ID 4613
acagttgtgatgaggcatcttcagtgt

SEQ ID NO: 6039 - DNA, 31 bp, Homo sapiens
  mature of SEQ ID 4613
atttggctgtgcttcttcagatgcgatatct

SEQ ID NO: 6040 - DNA, 33 bp, Homo sapiens
  mature of SEQ ID 4613
ctgtgcttcttcagatgcgatatctcatattgt

SEQ ID NO: 6041 - DNA, 17 bp, Homo sapiens
  mature of SEQ ID 4439
ctgtgagtgtagacatg

SEQ ID NO: 6042 - DNA, 18 bp, Homo sapiens
  mature of SEQ ID 5222
tttatattctgtacatat

SEQ ID NO: 6043 - DNA, 27 bp, Homo sapiens
  mature of SEQ ID 5220
ggcgcgtcctgggggagggcgcgggtg

SEQ ID NO: 6044 - DNA, 19 bp, Homo sapiens
  mature of SEQ ID 4262
ggaaccaaattgcagtttt

SEQ ID NO: 6045 - DNA, 32 bp, Homo sapiens
  mature of SEQ ID 4298
gctgcctgacggaagttgatgtcagctatcta

SEQ ID NO: 6046 - DNA, 29 bp, Homo sapiens
  mature of SEQ ID 4298
aggagctgcctgacggaagttgatgtcag

SEQ ID NO: 6047 - DNA, 18 bp, Homo sapiens
  mature of SEQ ID 5356
atgtttacttgaatttag

SEQ ID NO: 6048 - DNA, 28 bp, Homo sapiens
  mature of SEQ ID 5356
ctgacatgtaaattatgcagagtttgtg

SEQ ID NO: 6049 - DNA, 33 bp, Homo sapiens
  mature of SEQ ID 5511
aaaattcaaggagctgtcattttgagaattacc

SEQ ID NO: 6050 - DNA, 32 bp, Homo sapiens
  mature of SEQ ID 5266
gggataaatgtttcataaagaatccattatta

SEQ ID NO: 6051 - DNA, 30 bp, Homo sapiens
  mature of SEQ ID 5266
tgctagggataaatgtttcataaagaatcc

SEQ ID NO: 6052 - DNA, 25 bp, Homo sapiens
  mature of SEQ ID 5028
ccgtttgacactaatgttactctac

SEQ ID NO: 6053 - DNA, 31 bp, Homo sapiens
  mature of SEQ ID 5283
gtgtttcctcttctcctcttctggagaggga

SEQ ID NO: 6054 - DNA, 29 bp, Homo sapiens
  mature of SEQ ID 5283
tcttgtgtttcctcttctcctcttctgga

SEQ ID NO: 6055 - DNA, 31 bp, Homo sapiens
  mature of SEQ ID 5283
ttcacatccatgaagtaggaattggggctct

SEQ ID NO: 6056 - DNA, 33 bp, Homo sapiens
  mature of SEQ ID 5283
tccatgaagtaggaattggggctctgcaccagg

SEQ ID NO: 6057 - DNA, 25 bp, Homo sapiens
  mature of SEQ ID 5097
cctctgtctgtgttcggactccttt

SEQ ID NO: 6058 - DNA, 31 bp, Homo sapiens
  mature of SEQ ID 5097
gaaggagaaacttgaaccagacctttgacct

SEQ ID NO: 6059 - DNA, 20 bp, Homo sapiens
  mature of SEQ ID 4414
tcttgagtctgagtgtgctg

SEQ ID NO: 6060 - DNA, 33 bp, Homo sapiens
  mature of SEQ ID 4414
acagctatacagatatacacttgataatcagga

SEQ ID NO: 6061 - DNA, 29 bp, Homo sapiens
  mature of SEQ ID 5390
gcaaagcagagaattcacctcagtttgtg

SEQ ID NO: 6062 - DNA, 31 bp, Homo sapiens
  mature of SEQ ID 5390
agcagagaattcacctcagtttgtggtgtcc

SEQ ID NO: 6063 - DNA, 26 bp, Homo sapiens
  mature of SEQ ID 5390
gaaagggcagtcagtttggcatttgt

SEQ ID NO: 6064 - DNA, 31 bp, Homo sapiens
  mature of SEQ ID 4601
aaggcttgtgatgtgttgtgatagctgggtt

SEQ ID NO: 6065 - DNA, 32 bp, Homo sapiens
  mature of SEQ ID 4601
gcacttgatactaaccgagctgtctatatcct

SEQ ID NO: 6066 - DNA, 34 bp, Homo sapiens
  mature of SEQ ID 4090
aacatttacaagttgtcagggaacatgtacccac

SEQ ID NO: 6067 - DNA, 33 bp, Homo sapiens
  mature of SEQ ID 4052
gccttgctatctcgggttgcatatgctgggcat

SEQ ID NO: 6068 - DNA, 34 bp, Homo sapiens
  mature of SEQ ID 5682
ggaaggtggacagcaaggccaggatggagctgcc

SEQ ID NO: 6069 - DNA, 27 bp, Homo sapiens
  mature of SEQ ID 5682
tggagaggccagactcatcatactcct

SEQ ID NO: 6070 - DNA, 29 bp, Homo sapiens
  mature of SEQ ID 5108
gcgcgcacgctgctggccatgtccagctc

SEQ ID NO: 6071 - DNA, 31 bp, Homo sapiens
  mature of SEQ ID 5108
gagctgcgtggccatgcgccgctcgggctgt

SEQ ID NO: 6072 - DNA, 30 bp, Homo sapiens
  mature of SEQ ID 5125
cctttggtaacacgtggccttaatgcaact

SEQ ID NO: 6073 - DNA, 32 bp, Homo sapiens
  mature of SEQ ID 5125
ggtaacacgtggccttaatgcaactttagact

SEQ ID NO: 6074 - DNA, 17 bp, Homo sapiens
  mature of SEQ ID 5125
atgttataaattatgca

SEQ ID NO: 6075 - DNA, 29 bp, Homo sapiens
  mature of SEQ ID 5278
gttttaggaaattagtctgtgtactattt

SEQ ID NO: 6076 - DNA, 20 bp, Homo sapiens
  mature of SEQ ID 5278
atttagctccaaatgagaaa

SEQ ID NO: 6077 - DNA, 22 bp, Homo sapiens
  mature of SEQ ID 4220
attgctccccaaggcttggcag

SEQ ID NO: 6078 - DNA, 19 bp, Homo sapiens
  mature of SEQ ID 4220
ccattcatttttggtgata

SEQ ID NO: 6079 - DNA, 17 bp, Homo sapiens
  mature of SEQ ID 4589
tttctttttaatgttaa

SEQ ID NO: 6080 - DNA, 21 bp, Homo sapiens
  mature of SEQ ID 4589
gagaaagaaatcattacaact

SEQ ID NO: 6081 - DNA, 18 bp, Homo sapiens
  mature of SEQ ID 4139
gtctcatacacattcatg

SEQ ID NO: 6082 - DNA, 29 bp, Homo sapiens
  mature of SEQ ID 4139
tttatgaatatacccaatgggactggctt

SEQ ID NO: 6083 - DNA, 31 bp, Homo sapiens
  mature of SEQ ID 4139
tgaatatacccaatgggactggctttggaat

SEQ ID NO: 6084 - DNA, 19 bp, Homo sapiens
  mature of SEQ ID 4069
ggcttaaaattttatattg

SEQ ID NO: 6085 - DNA, 25 bp, Homo sapiens
  mature of SEQ ID 4069
gcactgcaaaacaggcaatgtaaaa

SEQ ID NO: 6086 - DNA, 33 bp, Homo sapiens
  mature of SEQ ID 5018
tattgatgctgatgggggtaggaaaggtcccca

SEQ ID NO: 6087 - DNA, 31 bp, Homo sapiens
  mature of SEQ ID 5018
aggttttattgatgctgatgggggtaggaaa

SEQ ID NO: 6088 - DNA, 25 bp, Homo sapiens
  mature of SEQ ID 5018
ctgagtcagtcagcaaatgcgtaag

SEQ ID NO: 6089 - DNA, 28 bp, Homo sapiens
  mature of SEQ ID 5527
gctgcgcgttcccggccacgcccgcgcg

SEQ ID NO: 6090 - DNA, 29 bp, Homo sapiens
  mature of SEQ ID 4506
attgtggtgcacactgggagttgtagtcc

SEQ ID NO: 6091 - DNA, 18 bp, Homo sapiens
  mature of SEQ ID 4506
ggggactacaactcccaa

SEQ ID NO: 6092 - DNA, 29 bp, Homo sapiens
  mature of SEQ ID 4329
cggggctcgggaccggctgccatcttagt

SEQ ID NO: 6093 - DNA, 31 bp, Homo sapiens
  mature of SEQ ID 4329
gactgaggagtcgccgccgccccgagtcccg

SEQ ID NO: 6094 - DNA, 24 bp, Homo sapiens
  mature of SEQ ID 5106
ttgtaaattgttccagcaaaaatt

SEQ ID NO: 6095 - DNA, 35 bp, Homo sapiens
  mature of SEQ ID 5034
atataccttattatggcattcagggagccagggtc

SEQ ID NO: 6096 - DNA, 26 bp, Homo sapiens
  mature of SEQ ID 5034
ttatggcattcagggagccagggtcc

SEQ ID NO: 6097 - DNA, 35 bp, Homo sapiens
  mature of SEQ ID 5034
tgccactcaaatataccttattatggcattcaggg

SEQ ID NO: 6098 - DNA, 32 bp, Homo sapiens
  mature of SEQ ID 5034
ggagaactggctcttggccactgtgaggggta

SEQ ID NO: 6099 - DNA, 17 bp, Homo sapiens
  mature of SEQ ID 5707
tatctgaattgtttgat

SEQ ID NO: 6100 - DNA, 34 bp, Homo sapiens
  mature of SEQ ID 5707
catatgttgtggttaggcatttaaatattctgta

SEQ ID NO: 6101 - DNA, 17 bp, Homo sapiens
  mature of SEQ ID 4922
gcctttcttgcgagtta

SEQ ID NO: 6102 - DNA, 22 bp, Homo sapiens
  mature of SEQ ID 4922
tagcaagcgactggggaatcag

SEQ ID NO: 6103 - DNA, 22 bp, Homo sapiens
  mature of SEQ ID 4922
tttgcttagagctgatgactta

SEQ ID NO: 6104 - DNA, 32 bp, Homo sapiens
  mature of SEQ ID 5579
acattaatgtgagttatctaagtacagtccta

SEQ ID NO: 6105 - DNA, 19 bp, Homo sapiens
  mature of SEQ ID 5579
gatgattcatagtaaggtc

SEQ ID NO: 6106 - DNA, 25 bp, Homo sapiens
  mature of SEQ ID 5195
tatacagatgcaattttggaatatt

SEQ ID NO: 6107 - DNA, 32 bp, Homo sapiens
  mature of SEQ ID 5195
gttttccaaatgatctttataaatcaaagtta

SEQ ID NO: 6108 - DNA, 21 bp, Homo sapiens
  mature of SEQ ID 4409
cagatgccagtggggaggggc

SEQ ID NO: 6109 - DNA, 23 bp, Homo sapiens
  mature of SEQ ID 4409
ccagcgcccgctttaaattggct

SEQ ID NO: 6110 - DNA, 27 bp, Homo sapiens
  mature of SEQ ID 4234
tgatattttcttcttatactctggatt

SEQ ID NO: 6111 - DNA, 21 bp, Homo sapiens
  mature of SEQ ID 4664
accggcagtgaccttaaaacc

SEQ ID NO: 6112 - DNA, 34 bp, Homo sapiens
  mature of SEQ ID 4664
agcaataatgtatagttttgtggtcattactggt

SEQ ID NO: 6113 - DNA, 18 bp, Homo sapiens
  mature of SEQ ID 4405
ctctttccccggtgggtg

SEQ ID NO: 6114 - DNA, 17 bp, Homo sapiens
  mature of SEQ ID 5051
tggcttgatgtttaacg

SEQ ID NO: 6115 - DNA, 26 bp, Homo sapiens
  mature of SEQ ID 4082
tcctccccatctttctttctttctcc

SEQ ID NO: 6116 - DNA, 26 bp, Homo sapiens
  mature of SEQ ID 4082
ccacccaggagccggagttgaggtgg

SEQ ID NO: 6117 - DNA, 32 bp, Homo sapiens
  mature of SEQ ID 4857
tcatgtgtctttggatcggtagccacgttcag

SEQ ID NO: 6118 - DNA, 24 bp, Homo sapiens
  mature of SEQ ID 4857
gcctaacaaggttactgaaggcca

SEQ ID NO: 6119 - DNA, 29 bp, Homo sapiens
  mature of SEQ ID 4579
agatgaggaaatgaattcatagctctgta

SEQ ID NO: 6120 - DNA, 17 bp, Homo sapiens
  mature of SEQ ID 4579
cattccttaatcaaatt

SEQ ID NO: 6121 - DNA, 32 bp, Homo sapiens
  mature of SEQ ID 5591
cctgggacaagcaggggcccaaccacccccag

SEQ ID NO: 6122 - DNA, 30 bp, Homo sapiens
  mature of SEQ ID 5591
acaaacctgggacaagcaggggcccaacca

SEQ ID NO: 6123 - DNA, 27 bp, Homo sapiens
  mature of SEQ ID 5591
gggccctctgcagctgcccagggcccc

SEQ ID NO: 6124 - DNA, 33 bp, Homo sapiens
  mature of SEQ ID 5162
tttcacaaatcacacttttgtttagacaagtga

SEQ ID NO: 6125 - DNA, 30 bp, Homo sapiens
  mature of SEQ ID 5162
tgccttttcacaaatcacacttttgtttag

SEQ ID NO: 6126 - DNA, 23 bp, Homo sapiens
  mature of SEQ ID 5230
ggattatcctctatgaatttctg

SEQ ID NO: 6127 - DNA, 32 bp, Homo sapiens
  mature of SEQ ID 5230
cagaagtgattctgaggcagggttatggaaag

SEQ ID NO: 6128 - DNA, 32 bp, Homo sapiens
  mature of SEQ ID 4715
agattgttttaaccacagctttgtaaatgttt

SEQ ID NO: 6129 - DNA, 33 bp, Homo sapiens
  mature of SEQ ID 4715
ttatgtaagctccgtgggttgaaaaggtagttt

SEQ ID NO: 6130 - DNA, 31 bp, Homo sapiens
  mature of SEQ ID 4715
aaatatttatgtaagctccgtgggttgaaaa

SEQ ID NO: 6131 - DNA, 27 bp, Homo sapiens
  mature of SEQ ID 4093
ctcaagtttaaattcatttgtttcagt

SEQ ID NO: 6132 - DNA, 30 bp, Homo sapiens
  mature of SEQ ID 4093
ataaaatgagacggatgacttttgctaaag

SEQ ID NO: 6133 - DNA, 30 bp, Homo sapiens
  mature of SEQ ID 5015
atgctcaggaacctcctcgaggctgtaaca

SEQ ID NO: 6134 - DNA, 29 bp, Homo sapiens
  mature of SEQ ID 5015
gtgtcgcaagttgaggtaggtaatatctt

SEQ ID NO: 6135 - DNA, 31 bp, Homo sapiens
  mature of SEQ ID 5015
cgcaagttgaggtaggtaatatcttgactat

SEQ ID NO: 6136 - DNA, 32 bp, Homo sapiens
  mature of SEQ ID 4926
gttacattcctgttttgccagttaggttggtt

SEQ ID NO: 6137 - DNA, 29 bp, Homo sapiens
  mature of SEQ ID 4926
ggaaatataaaaactctggacgacgggtg

SEQ ID NO: 6138 - DNA, 31 bp, Homo sapiens
  mature of SEQ ID 4926
atataaaaactctggacgacgggtgtgtagc

SEQ ID NO: 6139 - DNA, 20 bp, Homo sapiens
  mature of SEQ ID 4838
tgttcttcctcctcctcctg

SEQ ID NO: 6140 - DNA, 17 bp, Homo sapiens
  mature of SEQ ID 4838
gctgaggacatgaacct

SEQ ID NO: 6141 - DNA, 31 bp, Homo sapiens
  mature of SEQ ID 4560
gggaagatcatcttggcagaagtgtcattat

SEQ ID NO: 6142 - DNA, 19 bp, Homo sapiens
  mature of SEQ ID 4267
tggcatctgttcttgaatc

SEQ ID NO: 6143 - DNA, 18 bp, Homo sapiens
  mature of SEQ ID 4267
tctgggcacattagcagt

SEQ ID NO: 6144 - DNA, 33 bp, Homo sapiens
  mature of SEQ ID 5000
gtgcttagcaagataacctcgattcctgctggt

SEQ ID NO: 6145 - DNA, 26 bp, Homo sapiens
  mature of SEQ ID 5000
agaaccaggagctggactcttctgct

SEQ ID NO: 6146 - DNA, 17 bp, Homo sapiens
  mature of SEQ ID 5253
ggcattccattttgaca

SEQ ID NO: 6147 - DNA, 18 bp, Homo sapiens
  mature of SEQ ID 5253
gatttacatttatctcac

SEQ ID NO: 6148 - DNA, 21 bp, Homo sapiens
  mature of SEQ ID 4120
ggcctcgacccctaagggctt

SEQ ID NO: 6149 - DNA, 18 bp, Homo sapiens
  mature of SEQ ID 4120
ggggcctgtaactaagtc

SEQ ID NO: 6150 - DNA, 33 bp, Homo sapiens; identical to SEQ ID NO: 5916
  mature of SEQ ID 4709

SEQ ID NO: 6151 - DNA, 23 bp, Homo sapiens
  mature of SEQ ID 4385
ggcaattggaatgtcaattttat

SEQ ID NO: 6152 - DNA, 23 bp, Homo sapiens
  mature of SEQ ID 4385
atccagctgattgacaaaatcca

SEQ ID NO: 6153 - DNA, 31 bp, Homo sapiens
  mature of SEQ ID 5619
aggcttggctgggcctgtctgctgttggacc

SEQ ID NO: 6154 - DNA, 32 bp, Homo sapiens
  mature of SEQ ID 5086
ttggacaggcttctccacactgagctttacag

SEQ ID NO: 6155 - DNA, 29 bp, Homo sapiens
  mature of SEQ ID 5086
gaggttggacaggcttctccacactgagc

SEQ ID NO: 6156 - DNA, 30 bp, Homo sapiens
  mature of SEQ ID 5086
cctgcagagctcacaagccctgccagcttt

SEQ ID NO: 6157 - DNA, 17 bp, Homo sapiens
  mature of SEQ ID 5687
taactgtagaaatggcc

SEQ ID NO: 6158 - DNA, 21 bp, Homo sapiens
  mature of SEQ ID 5687
ggcttacagaattatgaacag

SEQ ID NO: 6159 - DNA, 22 bp, Homo sapiens
  mature of SEQ ID 5456
aggcactctgggtttagactgg

SEQ ID NO: 6160 - DNA, 20 bp, Homo sapiens
  mature of SEQ ID 5456
ccttgtgttaatatttactg

SEQ ID NO: 6161 - DNA, 19 bp, Homo sapiens
  mature of SEQ ID 5456
ccagtgcctgaattcaagg

SEQ ID NO: 6162 - DNA, 34 bp, Homo sapiens
  mature of SEQ ID 4247
atgtcagatgttccctgggaagtcctgctgaaaa

SEQ ID NO: 6163 - DNA, 32 bp, Homo sapiens
  mature of SEQ ID 5736
actcagcctgaagcactcagcatctggcttgc

SEQ ID NO: 6164 - DNA, 21 bp, Homo sapiens
  mature of SEQ ID 5736
gcagccaatggtgggagatgg

SEQ ID NO: 6165 - DNA, 29 bp, Homo sapiens
  mature of SEQ ID 4524
ttattcttttgcagtagggccttccatta

SEQ ID NO: 6166 - DNA, 31 bp, Homo sapiens
  mature of SEQ ID 4524
tcttttgcagtagggccttccattaggtatt

SEQ ID NO: 6167 - DNA, 27 bp, Homo sapiens
  mature of SEQ ID 4524
tgacatgtgaatgctcttttgtcaaag

SEQ ID NO: 6168 - DNA, 23 bp, Homo sapiens
  mature of SEQ ID 5534
tttatagacatatttggaatgga

SEQ ID NO: 6169 - DNA, 19 bp, Homo sapiens
  mature of SEQ ID 5011
tccaatttgattgctttgg

SEQ ID NO: 6170 - DNA, 23 bp, Homo sapiens
  mature of SEQ ID 5011
gcagtaccagaaacctattagta

SEQ ID NO: 6171 - DNA, 17 bp, Homo sapiens
  mature of SEQ ID 5011
tactgattctttatgtg

SEQ ID NO: 6172 - DNA, 32 bp, Homo sapiens
  mature of SEQ ID 5371
ctggtgaataaattcttgagccttcttcttct

SEQ ID NO: 6173 - DNA, 22 bp, Homo sapiens
  mature of SEQ ID 5371
agaggctcagagtgggttgcag

SEQ ID NO: 6174 - DNA, 20 bp, Homo sapiens
  mature of SEQ ID 4434
gaaaattcatctgatttaat

SEQ ID NO: 6175 - DNA, 33 bp, Homo sapiens
  mature of SEQ ID 4434
agttgttcaattgttttaatgagtcttgaatcc

SEQ ID NO: 6176 - DNA, 27 bp, Homo sapiens
  mature of SEQ ID 4335
aatctcatgaacaaagattttctgact

SEQ ID NO: 6177 - DNA, 30 bp, Homo sapiens
  mature of SEQ ID 4645
aggattccaaggtttcagagaagcaattga

SEQ ID NO: 6178 - DNA, 31 bp, Homo sapiens
  mature of SEQ ID 5459
agatgtaaaataaacccacatgcagttcttg

SEQ ID NO: 6179 - DNA, 29 bp, Homo sapiens
  mature of SEQ ID 5459
tctcagatgtaaaataaacccacatgcag

SEQ ID NO: 6180 - DNA, 26 bp, Homo sapiens
  mature of SEQ ID 4993
ttggaggctggcttgtggaagaagcc

SEQ ID NO: 6181 - DNA, 18 bp, Homo sapiens
  mature of SEQ ID 4993
tgaacaaagtaaaaggcc

SEQ ID NO: 6182 - DNA, 18 bp, Homo sapiens
  mature of SEQ ID 4627
aaaatgcagagcaggggg

SEQ ID NO: 6183 - DNA, 19 bp, Homo sapiens
  mature of SEQ ID 4627
gtgatgtctacaaatcaca

SEQ ID NO: 6184 - DNA, 26 bp, Homo sapiens
  mature of SEQ ID 5309
cagctgacacatatctccttataact

SEQ ID NO: 6185 - DNA, 35 bp, Homo sapiens
  mature of SEQ ID 5309
gaaaattaagcagctgacacatatctccttataac

SEQ ID NO: 6186 - DNA, 35 bp, Homo sapiens
  mature of SEQ ID 5309
gccagaaagtgaaaattaagcagctgacacatatc

SEQ ID NO: 6187 - DNA, 34 bp, Homo sapiens
  mature of SEQ ID 4831
tgcgagagttctttgaagaaaagaagttaagact

SEQ ID NO: 6188 - DNA, 31 bp, Homo sapiens
  mature of SEQ ID 4831
aagacttgcgagagttctttgaagaaaagaa

SEQ ID NO: 6189 - DNA, 18 bp, Homo sapiens
  mature of SEQ ID 4692
ttattagtgtctttgttt

SEQ ID NO: 6190 - DNA, 29 bp, Homo sapiens
  mature of SEQ ID 4692
tcttatgtttctgtaaataaaattgatag

SEQ ID NO: 6191 - DNA, 21 bp, Homo sapiens
  mature of SEQ ID 5233
aaaggtgggtttgcagagtac

SEQ ID NO: 6192 - DNA, 24 bp, Homo sapiens
  mature of SEQ ID 5233
ttcttatgtactcttttgcagata

SEQ ID NO: 6193 - DNA, 31 bp, Homo sapiens
  mature of SEQ ID 5693
aggtagatcataaatgagatgagtgcttgaa

SEQ ID NO: 6194 - DNA, 20 bp, Homo sapiens
  mature of SEQ ID 5693
tatttttaatacagacactc

SEQ ID NO: 6195 - DNA, 34 bp, Homo sapiens
  mature of SEQ ID 5050
acctctcctaacactcataaagagaatttgtgag

SEQ ID NO: 6196 - DNA, 25 bp, Homo sapiens
  mature of SEQ ID 4112
ttctatgaccaaaagtatttcacta

SEQ ID NO: 6197 - DNA, 32 bp, Homo sapiens
  mature of SEQ ID 4112
ccaagaagatgaaataatacataggtcatgaa

SEQ ID NO: 6198 - DNA, 29 bp, Homo sapiens
  mature of SEQ ID 4112
acttccaagaagatgaaataatacatagg

SEQ ID NO: 6199 - DNA, 28 bp, Homo sapiens
  mature of SEQ ID 4156
atctttgcatcccccgctgcaccctgtg

SEQ ID NO: 6200 - DNA, 31 bp, Homo sapiens
  mature of SEQ ID 4156
gtggatggtgtgcgggcggatgggtgagtga

SEQ ID NO: 6201 - DNA, 31 bp, Homo sapiens
  mature of SEQ ID 4216
actattgaaaagtccatgaaaatgattaaag

SEQ ID NO: 6202 - DNA, 29 bp, Homo sapiens
  mature of SEQ ID 4216
aaatactattgaaaagtccatgaaaatga

SEQ ID NO: 6203 - DNA, 30 bp, Homo sapiens
  mature of SEQ ID 4892
ctggtgaggagagctgtccggctgagcagc

SEQ ID NO: 6204 - DNA, 31 bp, Homo sapiens
  mature of SEQ ID 4469
ttcagtgaggcccaacagtgcaaggtggcag

SEQ ID NO: 6205 - DNA, 29 bp, Homo sapiens
  mature of SEQ ID 4469
agtgttcagtgaggcccaacagtgcaagg

SEQ ID NO: 6206 - DNA, 20 bp, Homo sapiens
  mature of SEQ ID 5552
cgactttgacatagtgtctc

SEQ ID NO: 6207 - DNA, 27 bp, Homo sapiens
  mature of SEQ ID 5552
ctaacagtcaaatgtctatcttcttct

SEQ ID NO: 6208 - DNA, 23 bp, Homo sapiens
  mature of SEQ ID 4382
tacttgaatgagatgacgactgg

SEQ ID NO: 6209 - DNA, 17 bp, Homo sapiens
  mature of SEQ ID 4382
taacttagctatggcca

SEQ ID NO: 6210 - DNA, 25 bp, Homo sapiens
  mature of SEQ ID 5017
ggtttctcttatgttcttctctgca

SEQ ID NO: 6211 - DNA, 30 bp, Homo sapiens
  mature of SEQ ID 5743
tcaggtgtctttctataggccttgttgctt

SEQ ID NO: 6212 - DNA, 22 bp, Homo sapiens
  mature of SEQ ID 5169
ctgcctgcccagcaggccaggt

SEQ ID NO: 6213 - DNA, 19 bp, Homo sapiens
  mature of SEQ ID 5133
gccctgggagctggcactg

SEQ ID NO: 6214 - DNA, 29 bp, Homo sapiens
  mature of SEQ ID 5133
cggaggttccagcagccgcggttcccttt

SEQ ID NO: 6215 - DNA, 31 bp, Homo sapiens
  mature of SEQ ID 5133
ggttccagcagccgcggttcccttttgtggc

SEQ ID NO: 6216 - DNA, 32 bp, Homo sapiens
  mature of SEQ ID 5320
catcctatgagaaactagtgggttgctgcctg

SEQ ID NO: 6217 - DNA, 32 bp, Homo sapiens
  mature of SEQ ID 5320
actatagtgaccttcctaggctctcaggggct

SEQ ID NO: 6218 - DNA, 28 bp, Homo sapiens
  mature of SEQ ID 4128
tctgtgcctgaagtggctgggtcccagc

SEQ ID NO: 6219 - DNA, 19 bp, Homo sapiens
  mature of SEQ ID 4128
cagccaatgtttctggaag

SEQ ID NO: 6220 - DNA, 21 bp, Homo sapiens
  mature of SEQ ID 4484
catggtcttcattgggggcat

SEQ ID NO: 6221 - DNA, 25 bp, Homo sapiens
  mature of SEQ ID 4512
tattgtctctcctttcgccacctcc

SEQ ID NO: 6222 - DNA, 33 bp, Homo sapiens
  mature of SEQ ID 4924
ggctgcctggatctggttagtgaaggttccagg

SEQ ID NO: 6223 - DNA, 22 bp, Homo sapiens
  mature of SEQ ID 5173
gtacaaaatactgcagttacag

SEQ ID NO: 6224 - DNA, 32 bp, Homo sapiens
  mature of SEQ ID 5745
tcacaataactgtgcatcccttcagagtaatg

SEQ ID NO: 6225 - DNA, 33 bp, Homo sapiens
  mature of SEQ ID 5745
cattttctggaatgtcgacagtctgattgctga

SEQ ID NO: 6226 - DNA, 24 bp, Homo sapiens
  mature of SEQ ID 4764
cagggtcaatcagctaaataaact

SEQ ID NO: 6227 - DNA, 19 bp, Homo sapiens
  mature of SEQ ID 4764
caagatggaattgactttg

SEQ ID NO: 6228 - DNA, 29 bp, Homo sapiens
  mature of SEQ ID 4635
tggtaacagtgggattttggaaaatgtca

SEQ ID NO: 6229 - DNA, 32 bp, Homo sapiens
  mature of SEQ ID 4635
aacagtgggattttggaaaatgtcactctttc

SEQ ID NO: 6230 - DNA, 23 bp, Homo sapiens
  mature of SEQ ID 4635
gaagaatcatttccaagctttct

SEQ ID NO: 6231 - DNA, 24 bp, Homo sapiens
  mature of SEQ ID 5124
tcaaatttatcagcagagaaggcc

SEQ ID NO: 6232 - DNA, 32 bp, Homo sapiens
  mature of SEQ ID 5124
ttttaaaaggttatctttagatttattactca

SEQ ID NO: 6233 - DNA, 17 bp, Homo sapiens
  mature of SEQ ID 5529
aaaaacataaattgagc

SEQ ID NO: 6234 - DNA, 19 bp, Homo sapiens
  mature of SEQ ID 5529
tctcacctcattaggcgtg

SEQ ID NO: 6235 - DNA, 22 bp, Homo sapiens
  mature of SEQ ID 5529
tttttcagaattttgtctatga

SEQ ID NO: 6236 - DNA, 21 bp, Homo sapiens
  mature of SEQ ID 4625
gtgcctttacctgctatttgg

SEQ ID NO: 6237 - DNA, 21 bp, Homo sapiens
  mature of SEQ ID 4625
ggtaaatacaatgtggaaggc

SEQ ID NO: 6238 - DNA, 33 bp, Homo sapiens
  mature of SEQ ID 5684
tataatctgactaatccaggcaatggaaatttg

SEQ ID NO: 6239 - DNA, 26 bp, Homo sapiens
  mature of SEQ ID 5684
agatttgcatgctgttttcagattgt

SEQ ID NO: 6240 - DNA, 34 bp, Homo sapiens
  mature of SEQ ID 5013
caggtacatcaagttctggatggctgcccactgg

SEQ ID NO: 6241 - DNA, 25 bp, Homo sapiens
  mature of SEQ ID 5013
ggccagaagagtagaaatattgaga

SEQ ID NO: 6242 - DNA, 24 bp, Homo sapiens
  mature of SEQ ID 4336
aacaattagttgtttcacatccag

SEQ ID NO: 6243 - DNA, 26 bp, Homo sapiens
  mature of SEQ ID 4336
ggtggctcagtggaatccattttgtt

SEQ ID NO: 6244 - DNA, 20 bp, Homo sapiens
  mature of SEQ ID 4529
ctcctttgcaatgttggaga

SEQ ID NO: 6245 - DNA, 28 bp, Homo sapiens
  mature of SEQ ID 4529
agaagttgccagaaattaaaatgtgcaa

SEQ ID NO: 6246 - DNA, 32 bp, Homo sapiens
  mature of SEQ ID 5170
ttgtcttatgatcaggcaaagcgggtgcctag

SEQ ID NO: 6247 - DNA, 30 bp, Homo sapiens
  mature of SEQ ID 5170
acgctttgtcttatgatcaggcaaagcggg

SEQ ID NO: 6248 - DNA, 32 bp, Homo sapiens
  mature of SEQ ID 5170
gattccctttaactggaacagaggcaaggtgt

SEQ ID NO: 6249 - DNA, 30 bp, Homo sapiens
  mature of SEQ ID 5170
atttggattccctttaactggaacagaggc

SEQ ID NO: 6250 - DNA, 22 bp, Homo sapiens
  mature of SEQ ID 5330
gtcgggaccgctgagattggtt

SEQ ID NO: 6251 - DNA, 26 bp, Homo sapiens
  mature of SEQ ID 5419
ctggtgtcccgggggctgctggcctc

SEQ ID NO: 6252 - DNA, 26 bp, Homo sapiens
  mature of SEQ ID 5419
aggtacaggcgctccttggtctccag

SEQ ID NO: 6253 - DNA, 18 bp, Homo sapiens
  mature of SEQ ID 4066
taaatagaatctttgttg

SEQ ID NO: 6254 - DNA, 27 bp, Homo sapiens
  mature of SEQ ID 5270
tctggctgccagagagttcttagagga

SEQ ID NO: 6255 - DNA, 17 bp, Homo sapiens
  mature of SEQ ID 5331
tccctggtatgacctgt

SEQ ID NO: 6256 - DNA, 32 bp, Homo sapiens
  mature of SEQ ID 5331
acaggtctgccaagatgctttgggaaacattt

SEQ ID NO: 6257 - DNA, 22 bp, Homo sapiens
  mature of SEQ ID 5331
aaatgccaagtctatttcaacg

SEQ ID NO: 6258 - DNA, 26 bp, Homo sapiens
  mature of SEQ ID 4646
gcgcgcatccgctatctgcaggcggc

SEQ ID NO: 6259 - DNA, 24 bp, Homo sapiens
  mature of SEQ ID 4646
gtcgcctgcaggaagtgttggcgc

SEQ ID NO: 6260 - DNA, 18 bp, Homo sapiens
  mature of SEQ ID 5293
ctcagctggaaagatctg

SEQ ID NO: 6261 - DNA, 23 bp, Homo sapiens
  mature of SEQ ID 5293
gcaattatttgatctttcctggg

SEQ ID NO: 6262 - DNA, 23 bp, Homo sapiens
  mature of SEQ ID 5614
gagtctggctcagggccaggaat

SEQ ID NO: 6263 - DNA, 32 bp, Homo sapiens
  mature of SEQ ID 5614
atgttatagtatttcaggatgatgtcaggctc

SEQ ID NO: 6264 - DNA, 30 bp, Homo sapiens
  mature of SEQ ID 5614
atagcatgttatagtatttcaggatgatgt

SEQ ID NO: 6265 - DNA, 24 bp, Homo sapiens
  mature of SEQ ID 4618
ctgcaaataaaatatcttttaaac

SEQ ID NO: 6266 - DNA, 30 bp, Homo sapiens
  mature of SEQ ID 4618
gtttgaaaaactgttttattgggttagaat

SEQ ID NO: 6267 - DNA, 33 bp, Homo sapiens
  mature of SEQ ID 4162
ctgaatttcccatttggggttttattagctttt

SEQ ID NO: 6268 - DNA, 31 bp, Homo sapiens
  mature of SEQ ID 4162
gacattgtgaagaaacccagattagaattca

SEQ ID NO: 6269 - DNA, 18 bp, Homo sapiens
  mature of SEQ ID 4925
tttgggccaatgaggcag

SEQ ID NO: 6270 - DNA, 34 bp, Homo sapiens
  mature of SEQ ID 5572
tgttttttggctcttgtattttgaagggctattt

SEQ ID NO: 6271 - DNA, 21 bp, Homo sapiens
  mature of SEQ ID 5572
aagaatgttagttccaaagga

SEQ ID NO: 6272 - DNA, 27 bp, Homo sapiens
  mature of SEQ ID 4197
tacctctcagcccatcttatttgccag

SEQ ID NO: 6273 - DNA, 29 bp, Homo sapiens
  mature of SEQ ID 5031
tagtcggctatgttgtggtccacgatgag

SEQ ID NO: 6274 - DNA, 20 bp, Homo sapiens
  mature of SEQ ID 4185
aggtaggaatattaaaaagg

SEQ ID NO: 6275 - DNA, 25 bp, Homo sapiens
  mature of SEQ ID 4157
cagtgtgtttggtacatgctgtgtt

SEQ ID NO: 6276 - DNA, 25 bp, Homo sapiens
  mature of SEQ ID 5084
gttttattttgcaccaaatttaagc

SEQ ID NO: 6277 - DNA, 31 bp, Homo sapiens
  mature of SEQ ID 5084
catgaagagcttttaattttgcaattaatag

SEQ ID NO: 6278 - DNA, 33 bp, Homo sapiens
  mature of SEQ ID 4341
ccatatgaaaaaggagttaataaaatgcacatt

SEQ ID NO: 6279 - DNA, 31 bp, Homo sapiens
  mature of SEQ ID 4341
catgtaccatatgaaaaaggagttaataaaa

SEQ ID NO: 6280 - DNA, 17 bp, Homo sapiens
  mature of SEQ ID 4341
ttttcatctggtggcag

SEQ ID NO: 6281 - DNA, 33 bp, Homo sapiens
  mature of SEQ ID 5062
tttgatatttatgaaatgccagttttccataaa

SEQ ID NO: 6282 - DNA, 18 bp, Homo sapiens
  mature of SEQ ID 5062
tttatatattcatagaaa

SEQ ID NO: 6283 - DNA, 19 bp, Homo sapiens
  mature of SEQ ID 5447
agtcctgttctaagacctt

SEQ ID NO: 6284 - DNA, 28 bp, Homo sapiens
  mature of SEQ ID 5447
aacgttatgattgtgaagaacaggcact

SEQ ID NO: 6285 - DNA, 17 bp, Homo sapiens
  mature of SEQ ID 4724
gtgccacccgcaggtgt

SEQ ID NO: 6286 - DNA, 19 bp, Homo sapiens
  mature of SEQ ID 4724
agaggcccggaataggcgc

SEQ ID NO: 6287 - DNA, 23 bp, Homo sapiens
  mature of SEQ ID 4573
gtcatactgagcccttctgtccc

SEQ ID NO: 6288 - DNA, 33 bp, Homo sapiens
  mature of SEQ ID 4573
tggggacaaaggctgtgctgtgcctggccccgg

SEQ ID NO: 6289 - DNA, 18 bp, Homo sapiens
  mature of SEQ ID 5372
atgaaagttctagaaagg

SEQ ID NO: 6290 - DNA, 31 bp, Homo sapiens
  mature of SEQ ID 4622
gaaagtgattccaagttgaaatgcatgttat

SEQ ID NO: 6291 - DNA, 17 bp, Homo sapiens
  mature of SEQ ID 5343
gccaaaagcagatgggc

SEQ ID NO: 6292 - DNA, 19 bp, Homo sapiens
  mature of SEQ ID 5343
gccttttttctgccaagtt

SEQ ID NO: 6293 - DNA, 33 bp, Homo sapiens
  mature of SEQ ID 4916
aggagagttgggacttcaacatctttgaattgg

SEQ ID NO: 6294 - DNA, 30 bp, Homo sapiens
  mature of SEQ ID 4916
taatgaggagagttgggacttcaacatctt

SEQ ID NO: 6295 - DNA, 19 bp, Homo sapiens
  mature of SEQ ID 4916
ccatcaatgatgttccccc

SEQ ID NO: 6296 - DNA, 31 bp, Homo sapiens
  mature of SEQ ID 4660
gaatcactccaatgattttaaatcactcttc

SEQ ID NO: 6297 - DNA, 31 bp, Homo sapiens
  mature of SEQ ID 4660
gcagagcaatttaaaattactggagtgcttc

SEQ ID NO: 6298 - DNA, 19 bp, Homo sapiens
  mature of SEQ ID 5187
ttaattggtgggtggtaaa

SEQ ID NO: 6299 - DNA, 24 bp, Homo sapiens
  mature of SEQ ID 5187
ctgggagcagcagctacctgtcca

SEQ ID NO: 6300 - DNA, 32 bp, Homo sapiens
  mature of SEQ ID 4932
gaggaacagccggtaatgccctcatggatgga

SEQ ID NO: 6301 - DNA, 35 bp, Homo sapiens
  mature of SEQ ID 4932
aaacaggaccatgaccattcacaacggcatgttct

SEQ ID NO: 6302 - DNA, 32 bp, Homo sapiens
  mature of SEQ ID 4932
tgggagaaaacaggaccatgaccattcacaac

SEQ ID NO: 6303 - DNA, 23 bp, Homo sapiens
  mature of SEQ ID 4354
aaatagtgtcagggttgggaaga

SEQ ID NO: 6304 - DNA, 17 bp, Homo sapiens
  mature of SEQ ID 4354
tttaagttttcctgagt

SEQ ID NO: 6305 - DNA, 23 bp, Homo sapiens
  mature of SEQ ID 5081
agttctccccaaggaagggcccc

SEQ ID NO: 6306 - DNA, 33 bp, Homo sapiens
  mature of SEQ ID 5081
cctggcgtgaggggagcctccggggagcgggtc

SEQ ID NO: 6307 - DNA, 22 bp, Homo sapiens
  mature of SEQ ID 4615
aaatatctaatatgtaggcttt

SEQ ID NO: 6308 - DNA, 17 bp, Homo sapiens
  mature of SEQ ID 4615
ttatttggtataataaa

SEQ ID NO: 6309 - DNA, 31 bp, Homo sapiens
  mature of SEQ ID 5078
gaagttttatctgattggcaaaatggaccca

SEQ ID NO: 6310 - DNA, 29 bp, Homo sapiens
  mature of SEQ ID 5246
tagatattgcatgtttaaaaattgaacag

SEQ ID NO: 6311 - DNA, 34 bp, Homo sapiens
  mature of SEQ ID 5246
tagcatgtttcaatttttaaaaagccatttattt

SEQ ID NO: 6312 - DNA, 18 bp, Homo sapiens
  mature of SEQ ID 5349
agtgatattccacagttt

SEQ ID NO: 6313 - DNA, 27 bp, Homo sapiens
  mature of SEQ ID 4277
ggctgcaggtgttctcagcattgtggt

SEQ ID NO: 6314 - DNA, 19 bp, Homo sapiens
  mature of SEQ ID 4277
ggggagttgaagcacctgc

SEQ ID NO: 6315 - DNA, 19 bp, Homo sapiens
  mature of SEQ ID 4528
ctttctgtgatcattacct

SEQ ID NO: 6316 - DNA, 32 bp, Homo sapiens
  mature of SEQ ID 5600
ctgcttctcccaggatgcactgggagcctggg

SEQ ID NO: 6317 - DNA, 31 bp, Homo sapiens
  mature of SEQ ID 5520
acattaatgtgagttatctaagtacagtcct

SEQ ID NO: 6318 - DNA, 18 bp, Homo sapiens
  mature of SEQ ID 5520
gatgattcatagcaaggt

SEQ ID NO: 6319 - DNA, 24 bp, Homo sapiens
  mature of SEQ ID 5637
cccccgggggccgcgcgctggggc

SEQ ID NO: 6320 - DNA, 20 bp, Homo sapiens
  mature of SEQ ID 5637
ggccagggggcgcgagcatg

SEQ ID NO: 6321 - DNA, 32 bp, Homo sapiens
  mature of SEQ ID 4873
gcaagttgggaaatgctgcagtagtctaagat

SEQ ID NO: 6322 - DNA, 21 bp, Homo sapiens
  mature of SEQ ID 5116
aataaaactccaactctatta

SEQ ID NO: 6323 - DNA, 20 bp, Homo sapiens
  mature of SEQ ID 5116
tggaagttagcttgtgaatt

SEQ ID NO: 6324 - DNA, 25 bp, Homo sapiens
  mature of SEQ ID 5665
gagagaagagaggtcaacatactgt

SEQ ID NO: 6325 - DNA, 19 bp, Homo sapiens
  mature of SEQ ID 5665
acatatagttgtccaatgc

SEQ ID NO: 6326 - DNA, 20 bp, Homo sapiens
  mature of SEQ ID 4508
gcctgagaaatttgctgaca

SEQ ID NO: 6327 - DNA, 31 bp, Homo sapiens
  mature of SEQ ID 5540
aatatcacactgtccaatttggtcaaattgg

SEQ ID NO: 6328 - DNA, 26 bp, Homo sapiens
  mature of SEQ ID 5540
gccaattgagattgacatgtgctgtt

SEQ ID NO: 6329 - DNA, 19 bp, Homo sapiens
  mature of SEQ ID 4870
aaaaaatggtcactttcat

SEQ ID NO: 6330 - DNA, 34 bp, Homo sapiens
  mature of SEQ ID 4870
acctttgtggttcttggaagaagatattttaaga

SEQ ID NO: 6331 - DNA, 17 bp, Homo sapiens
  mature of SEQ ID 4881
cattcaccttgatgagg

SEQ ID NO: 6332 - DNA, 23 bp, Homo sapiens
  mature of SEQ ID 4881
cagtctccaaatcaatctgaatg

SEQ ID NO: 6333 - DNA, 30 bp, Homo sapiens
  mature of SEQ ID 4658
aggcagtggtgcctaagcgcggaggcgccc

SEQ ID NO: 6334 - DNA, 20 bp, Homo sapiens
  mature of SEQ ID 5306
cctgacaagtgctttatcat

SEQ ID NO: 6335 - DNA, 21 bp, Homo sapiens
  mature of SEQ ID 5180
gagcttgttttgtgagcatgc

SEQ ID NO: 6336 - DNA, 28 bp, Homo sapiens
  mature of SEQ ID 5092
tttcatgggtatatagtggctttccatt

SEQ ID NO: 6337 - DNA, 18 bp, Homo sapiens
  mature of SEQ ID 4711
tgctggccttggctctgg

SEQ ID NO: 6338 - DNA, 23 bp, Homo sapiens
  mature of SEQ ID 4711
ccagggtgattccccagctgggc

SEQ ID NO: 6339 - DNA, 21 bp, Homo sapiens
  mature of SEQ ID 5232
catatgcaactgtctttcctg

SEQ ID NO: 6340 - DNA, 28 bp, Homo sapiens
  mature of SEQ ID 4166
tgacaagacgatagtgttgttacttcca

SEQ ID NO: 6341 - DNA, 24 bp, Homo sapiens
  mature of SEQ ID 4166
tagaattgtggaagtgaaagctat

SEQ ID NO: 6342 - DNA, 18 bp, Homo sapiens
  mature of SEQ ID 5073
gggagttcaaacctcaac

SEQ ID NO: 6343 - DNA, 25 bp, Homo sapiens
  mature of SEQ ID 5073
tgatttgctgtggccatgaagtctg

SEQ ID NO: 6344 - DNA, 27 bp, Homo sapiens
  mature of SEQ ID 4467
gaattgctttacgctcaaatagagaaa

SEQ ID NO: 6345 - DNA, 25 bp, Homo sapiens
  mature of SEQ ID 4467
tttctctgaagtgtaaagaaaattt

SEQ ID NO: 6346 - DNA, 33 bp, Homo sapiens
  mature of SEQ ID 4455
ctggatggtggtgtctggggactgggactcctt

SEQ ID NO: 6347 - DNA, 23 bp, Homo sapiens
  mature of SEQ ID 4455
tattgattaagttgttccagttt

SEQ ID NO: 6348 - DNA, 20 bp, Homo sapiens
  mature of SEQ ID 4778
tttagcttgtgtcagtcagc

SEQ ID NO: 6349 - DNA, 30 bp, Homo sapiens
  mature of SEQ ID 4778
gctgactgagggctgacactaaagccagta

SEQ ID NO: 6350 - DNA, 25 bp, Homo sapiens
  mature of SEQ ID 4523
agtctgggagctgatacaaatggag

SEQ ID NO: 6351 - DNA, 32 bp, Homo sapiens
  mature of SEQ ID 4523
tttgttacgctcagctcccttctatcaattcc

SEQ ID NO: 6352 - DNA, 30 bp, Homo sapiens
  mature of SEQ ID 4893
atcaccaccagctgagtcttcttgttctcc

SEQ ID NO: 6353 - DNA, 31 bp, Homo sapiens
  mature of SEQ ID 4353
gaactttagctttggtctatgaaaaggtttt

SEQ ID NO: 6354 - DNA, 32 bp, Homo sapiens
  mature of SEQ ID 4353
aacataaacattcggcagatttctttccctga

SEQ ID NO: 6355 - DNA, 29 bp, Homo sapiens
  mature of SEQ ID 4353
tgggaacataaacattcggcagatttctt

SEQ ID NO: 6356 - DNA, 29 bp, Homo sapiens
  mature of SEQ ID 4496
taggtgagtggaattgctattatagagtg

SEQ ID NO: 6357 - DNA, 31 bp, Homo sapiens
  mature of SEQ ID 4496
tgagtggaattgctattatagagtgttaata

SEQ ID NO: 6358 - DNA, 19 bp, Homo sapiens
  mature of SEQ ID 5606
gctgcattgttattaggga

SEQ ID NO: 6359 - DNA, 34 bp, Homo sapiens
  mature of SEQ ID 5606
tttttctatatgacagttcagttttaaaattgta

SEQ ID NO: 6360 - DNA, 32 bp, Homo sapiens
  mature of SEQ ID 5606
gctgtaatttttctatatgacagttcagtttt

SEQ ID NO: 6361 - DNA, 27 bp, Homo sapiens
  mature of SEQ ID 4940
atatatgtacacccattatgttttcag

SEQ ID NO: 6362 - DNA, 21 bp, Homo sapiens
  mature of SEQ ID 4940
ctggtaaacatgacctggaca

SEQ ID NO: 6363 - DNA, 25 bp, Homo sapiens
  mature of SEQ ID 5709
ttgggttcaaagtctgtttttcttt

SEQ ID NO: 6364 - DNA, 29 bp, Homo sapiens
  mature of SEQ ID 4079
cagaatttttatgtaaagtcttatcatac

SEQ ID NO: 6365 - DNA, 27 bp, Homo sapiens
  mature of SEQ ID 5424
tgagtaatctaaaataagagctggcaa

SEQ ID NO: 6366 - DNA, 32 bp, Homo sapiens
  mature of SEQ ID 5424
ttgccagctgttgcacatttaccagcccagtt

SEQ ID NO: 6367 - DNA, 31 bp, Homo sapiens
  mature of SEQ ID 4677
cattatataagtggttatttctaggttgcat

SEQ ID NO: 6368 - DNA, 33 bp, Homo sapiens
  mature of SEQ ID 4285
tatataaatccatatagtaattaaaatatagtc

SEQ ID NO: 6369 - DNA, 26 bp, Homo sapiens
  mature of SEQ ID 4285
gactgtaacaatggaggagaagtaga

SEQ ID NO: 6370 - DNA, 22 bp, Homo sapiens
  mature of SEQ ID 5363
tgtatatttggcatttggaatc

SEQ ID NO: 6371 - DNA, 29 bp, Homo sapiens
  mature of SEQ ID 5363
cttccaggatattctaaaagccccgaggc

SEQ ID NO: 6372 - DNA, 31 bp, Homo sapiens
  mature of SEQ ID 5363
caggatattctaaaagccccgaggcgggagt

SEQ ID NO: 6373 - DNA, 28 bp, Homo sapiens
  mature of SEQ ID 4242
aagtcaacatctgctgctttcctgtgga

SEQ ID NO: 6374 - DNA, 27 bp, Homo sapiens
  mature of SEQ ID 4242
tccacaggagggagctgacgttggctt

SEQ ID NO: 6375 - DNA, 33 bp, Homo sapiens
  mature of SEQ ID 5468
gaaatctcaagggtcaaagatttgaaaatgttt

SEQ ID NO: 6376 - DNA, 31 bp, Homo sapiens
  mature of SEQ ID 5468
agtacagaaatctcaagggtcaaagatttga

SEQ ID NO: 6377 - DNA, 33 bp, Homo sapiens
  mature of SEQ ID 4337
gacaggagtacaatatttgtaagcttttatttg

SEQ ID NO: 6378 - DNA, 34 bp, Homo sapiens
  mature of SEQ ID 4337
tataccaaatatctatgagcaattgtgagtaaaa

SEQ ID NO: 6379 - DNA, 36 bp, Homo sapiens
  mature of SEQ ID 4337
tatctatgagcaattgtgagtaaaataccttctgtc

SEQ ID NO: 6380 - DNA, 22 bp, Homo sapiens
  mature of SEQ ID 5532
accacttctgcagttgatttac

SEQ ID NO: 6381 - DNA, 31 bp, Homo sapiens
  mature of SEQ ID 5532
acagtggtgagaattttaatgcacgagtggt

SEQ ID NO: 6382 - DNA, 29 bp, Homo sapiens
  mature of SEQ ID 5532
gtatacagtggtgagaattttaatgcacg

SEQ ID NO: 6383 - DNA, 23 bp, Homo sapiens
  mature of SEQ ID 4423
ccattttcaaagtgctttgcaat

SEQ ID NO: 6384 - DNA, 22 bp, Homo sapiens
  mature of SEQ ID 4036
tttgtgttgaggttttgtggtt

SEQ ID NO: 6385 - DNA, 21 bp, Homo sapiens
  mature of SEQ ID 4036
agatttatttttaaattaacc

SEQ ID NO: 6386 - DNA, 24 bp, Homo sapiens
  mature of SEQ ID 5025
gggcgcttttttcttccatctggc

SEQ ID NO: 6387 - DNA, 19 bp, Homo sapiens
  mature of SEQ ID 5025
gcttggagggagtccgccc

SEQ ID NO: 6388 - DNA, 24 bp, Homo sapiens
  mature of SEQ ID 4461
taggactacaactcccagaaggcc

SEQ ID NO: 6389 - DNA, 20 bp, Homo sapiens
  mature of SEQ ID 4461
ggcctgggagctgtagtccg

SEQ ID NO: 6390 - DNA, 19 bp, Homo sapiens
  mature of SEQ ID 5726
attcaagaaatcattgagc

SEQ ID NO: 6391 - DNA, 18 bp, Homo sapiens
  mature of SEQ ID 5555
ccagcattttctgttcct

SEQ ID NO: 6392 - DNA, 18 bp, Homo sapiens
  mature of SEQ ID 5555
aggacatcagaaccaatt

SEQ ID NO: 6393 - DNA, 27 bp, Homo sapiens
  mature of SEQ ID 5161
accaagtgcaaattctgaattcttata

SEQ ID NO: 6394 - DNA, 23 bp, Homo sapiens
  mature of SEQ ID 4995
ttgctttagcttttaaatggctt

SEQ ID NO: 6395 - DNA, 24 bp, Homo sapiens
  mature of SEQ ID 5199
gctctaaagatttataaaggttgc

SEQ ID NO: 6396 - DNA, 29 bp, Homo sapiens
  mature of SEQ ID 4294
actgaccaaaatgttgatttcctagctga

SEQ ID NO: 6397 - DNA, 32 bp, Homo sapiens
  mature of SEQ ID 4294
accaaaatgttgatttcctagctgacacctgg

SEQ ID NO: 6398 - DNA, 32 bp, Homo sapiens
  mature of SEQ ID 4294
aggtggcatccattaggacaaacattatgaaa

SEQ ID NO: 6399 - DNA, 30 bp, Homo sapiens
  mature of SEQ ID 4294
tttccaggtggcatccattaggacaaacat

SEQ ID NO: 6400 - DNA, 22 bp, Homo sapiens
  mature of SEQ ID 4826
acagggagctgatgctctctgc

SEQ ID NO: 6401 - DNA, 24 bp, Homo sapiens
  mature of SEQ ID 4826
gtgctgaaggcattggtgatctgt

SEQ ID NO: 6402 - DNA, 19 bp, Homo sapiens
  mature of SEQ ID 4911
attaaggaagtgcttatat

SEQ ID NO: 6403 - DNA, 20 bp, Homo sapiens
  mature of SEQ ID 4911
tgtcctcttaatttactttt

SEQ ID NO: 6404 - DNA, 25 bp, Homo sapiens
  mature of SEQ ID 4672
tttttacaatcatgttattttgtgg

SEQ ID NO: 6405 - DNA, 33 bp, Homo sapiens
  mature of SEQ ID 4672
aatgcattgtgagccaagtttgcttcaaatgtg

SEQ ID NO: 6406 - DNA, 31 bp, Homo sapiens
  mature of SEQ ID 4672
ttgcaaaatgcattgtgagccaagtttgctt

SEQ ID NO: 6407 - DNA, 17 bp, Homo sapiens
  mature of SEQ ID 4672
tacttttgcagttaaca

SEQ ID NO: 6408 - DNA, 27 bp, Homo sapiens
  mature of SEQ ID 4213
acttggtaatttgatttagacagggga

SEQ ID NO: 6409 - DNA, 24 bp, Homo sapiens
  mature of SEQ ID 4213
tctgctgataaatctaggtagatt

SEQ ID NO: 6410 - DNA, 17 bp, Homo sapiens
  mature of SEQ ID 4310
ctgcagctccacatttg

SEQ ID NO: 6411 - DNA, 35 bp, Homo sapiens
  mature of SEQ ID 4310
aatagatacttgaatcagatggagaggagctgtag

SEQ ID NO: 6412 - DNA, 33 bp, Homo sapiens
  mature of SEQ ID 4310
gagatggtaatagatacttgaatcagatggaga

SEQ ID NO: 6413 - DNA, 23 bp, Homo sapiens
  mature of SEQ ID 4310
aggccttgtctaagtggcatctc

SEQ ID NO: 6414 - DNA, 33 bp, Homo sapiens
  mature of SEQ ID 4719
tcattttgctaggtggctagtcttgtgcagctt

SEQ ID NO: 6415 - DNA, 26 bp, Homo sapiens
  mature of SEQ ID 4719
ctgtcagttgcaatcaaggctgccca

SEQ ID NO: 6416 - DNA, 19 bp, Homo sapiens
  mature of SEQ ID 4541
aatgttcctaatctaatgg

SEQ ID NO: 6417 - DNA, 17 bp, Homo sapiens
  mature of SEQ ID 5758
ctgatttatgagggcca

SEQ ID NO: 6418 - DNA, 21 bp, Homo sapiens
  mature of SEQ ID 5758
cagcgtcctccactctccttc

SEQ ID NO: 6419 - DNA, 21 bp, Homo sapiens
  mature of SEQ ID 5758
gatgcagacagacagtttgtg

SEQ ID NO: 6420 - DNA, 18 bp, Homo sapiens
  mature of SEQ ID 4518
cagctccagaagcatgat

SEQ ID NO: 6421 - DNA, 22 bp, Homo sapiens
  mature of SEQ ID 4518
gtcgtggttcaggtgggtgggg

SEQ ID NO: 6422 - DNA, 19 bp, Homo sapiens
  mature of SEQ ID 4824
gtccacaaaggtatcattc

SEQ ID NO: 6423 - DNA, 24 bp, Homo sapiens
  mature of SEQ ID 4824
aacagagttgtatttttggtggac

SEQ ID NO: 6424 - DNA, 25 bp, Homo sapiens
  mature of SEQ ID 4568
ccagccaggcccaggggtagctgca

SEQ ID NO: 6425 - DNA, 24 bp, Homo sapiens
  mature of SEQ ID 4568
ggctaaaaataactctggggcctc

SEQ ID NO: 6426 - DNA, 32 bp, Homo sapiens
  mature of SEQ ID 4094
tcattaagatggatgaaataaccatattgact

SEQ ID NO: 6427 - DNA, 24 bp, Homo sapiens
  mature of SEQ ID 4657
tgagagcctgaggggccattttca

SEQ ID NO: 6428 - DNA, 30 bp, Homo sapiens
  mature of SEQ ID 4657
ggaagctcttcattggagggctgagctttg

SEQ ID NO: 6429 - DNA, 22 bp, Homo sapiens
  mature of SEQ ID 4276
aataggagctgttcttttattt

SEQ ID NO: 6430 - DNA, 19 bp, Homo sapiens
  mature of SEQ ID 4276
tctgcacaactcgacagtt

SEQ ID NO: 6431 - DNA, 24 bp, Homo sapiens
  mature of SEQ ID 5252
gccctgggcagctttgtctgttgc

SEQ ID NO: 6432 - DNA, 27 bp, Homo sapiens
  mature of SEQ ID 5715
tagctataacttgcttaattattcatt

SEQ ID NO: 6433 - DNA, 24 bp, Homo sapiens
  mature of SEQ ID 5715
gttttagtttgaagcaatgtgctg

SEQ ID NO: 6434 - DNA, 31 bp, Homo sapiens
  mature of SEQ ID 5163
tcttgaagaaatgaaggtgggcaacgttgtg

SEQ ID NO: 6435 - DNA, 28 bp, Homo sapiens
  mature of SEQ ID 5163
tacaactgtcaccttcataaacttcttg

SEQ ID NO: 6436 - DNA, 21 bp, Homo sapiens
  mature of SEQ ID 4832
aagctctggagccttaagcac

SEQ ID NO: 6437 - DNA, 22 bp, Homo sapiens
  mature of SEQ ID 5451
attacttcatgtctcttcaaaa

SEQ ID NO: 6438 - DNA, 23 bp, Homo sapiens
  mature of SEQ ID 5451
tgatttgtgtttttgagatagag

SEQ ID NO: 6439 - DNA, 19 bp, Homo sapiens
  mature of SEQ ID 5451
ctttcaaagaaacaagtca

SEQ ID NO: 6440 - DNA, 23 bp, Homo sapiens
  mature of SEQ ID 5746
gaggacaagagcgaggaccagcg

SEQ ID NO: 6441 - DNA, 26 bp, Homo sapiens
  mature of SEQ ID 5746
ctcttgttggaagcgccagatgtgtc

SEQ ID NO: 6442 - DNA, 22 bp, Homo sapiens
  mature of SEQ ID 4502
cactggagagaaaggatttggc

SEQ ID NO: 6443 - DNA, 18 bp, Homo sapiens
  mature of SEQ ID 5250
ggacgtgcgggccgtttc

SEQ ID NO: 6444 - DNA, 25 bp, Homo sapiens
  mature of SEQ ID 5250
gagtcactgagccccaccaacggcc

SEQ ID NO: 6445 - DNA, 33 bp, Homo sapiens
  mature of SEQ ID 4144
ggcccgtgcagctggcgccgggctcgctggcgc

SEQ ID NO: 6446 - DNA, 23 bp, Homo sapiens
  mature of SEQ ID 4933
gctgtgttggggctggtgaactg

SEQ ID NO: 6447 - DNA, 34 bp, Homo sapiens
  mature of SEQ ID 4933
aggcccagctctgtttgctctgatgttcttttag

SEQ ID NO: 6448 - DNA, 32 bp, Homo sapiens
  mature of SEQ ID 4933
cttttaaaggcccagctctgtttgctctgatg

SEQ ID NO: 6449 - DNA, 19 bp, Homo sapiens
  mature of SEQ ID 4799
ctgtgtcactttgtggggt

SEQ ID NO: 6450 - DNA, 22 bp, Homo sapiens
  mature of SEQ ID 4844
aaaatgtcaaagccagcaggct

SEQ ID NO: 6451 - DNA, 17 bp, Homo sapiens
  mature of SEQ ID 4688
gtgtgaaattttgcatg

SEQ ID NO: 6452 - DNA, 29 bp, Homo sapiens
  mature of SEQ ID 4688
caggggagatcaaagcatttagtcattct

SEQ ID NO: 6453 - DNA, 32 bp, Homo sapiens
  mature of SEQ ID 4688
ggagatcaaagcatttagtcattcttgtccac

SEQ ID NO: 6454 - DNA, 30 bp, Homo sapiens
  mature of SEQ ID 4107
tcattcatgcataaacaatatcattttcat

SEQ ID NO: 6455 - DNA, 30 bp, Homo sapiens
  mature of SEQ ID 4107
atggaagtgctatgtgttatgcagagtgca

SEQ ID NO: 6456 - DNA, 34 bp, Homo sapiens
  mature of SEQ ID 5337
actggctcgagtaagcatcctgcaaacatttggc

SEQ ID NO: 6457 - DNA, 32 bp, Homo sapiens
  mature of SEQ ID 5337
aggaggaggccaattaaaacacagtctgtcta

SEQ ID NO: 6458 - DNA, 34 bp, Homo sapiens
  mature of SEQ ID 5337
ggccaattaaaacacagtctgtctaactgccagt

SEQ ID NO: 6459 - DNA, 25 bp, Homo sapiens
  mature of SEQ ID 5098
gatttataatttgttcttaatttgc

SEQ ID NO: 6460 - DNA, 18 bp, Homo sapiens
  mature of SEQ ID 5098
taattatttgcatggtag

SEQ ID NO: 6461 - DNA, 20 bp, Homo sapiens
  mature of SEQ ID 4773
ctgacagtgtaaagaaaaaa

SEQ ID NO: 6462 - DNA, 22 bp, Homo sapiens
  mature of SEQ ID 5420
ttggaactcccattgaggagat

SEQ ID NO: 6463 - DNA, 18 bp, Homo sapiens
  mature of SEQ ID 5420
atgcctcagtgtgggatc

SEQ ID NO: 6464 - DNA, 19 bp, Homo sapiens
  mature of SEQ ID 4357
agaaagattttggaacata

SEQ ID NO: 6465 - DNA, 27 bp, Homo sapiens
  mature of SEQ ID 5016
cgtcctccgggaataggcaggaacctc

SEQ ID NO: 6466 - DNA, 19 bp, Homo sapiens
  mature of SEQ ID 5453
catttcagccattatttgc

SEQ ID NO: 6467 - DNA, 19 bp, Homo sapiens
  mature of SEQ ID 5449
catcttccattagagctgt

SEQ ID NO: 6468 - DNA, 26 bp, Homo sapiens
  mature of SEQ ID 5449
gcaattgtgatagaggccagactgag

SEQ ID NO: 6469 - DNA, 18 bp, Homo sapiens
  mature of SEQ ID 5436
gtagacaggaaatctgtc

SEQ ID NO: 6470 - DNA, 22 bp, Homo sapiens
  mature of SEQ ID 5749
aatattccttggcctgaagcta

SEQ ID NO: 6471 - DNA, 27 bp, Homo sapiens
  mature of SEQ ID 4064
ttgccagtctccaaatcaatctgaatg

SEQ ID NO: 6472 - DNA, 22 bp, Homo sapiens
  mature of SEQ ID 4064
cattcaccttgatgaggggatc

SEQ ID NO: 6473 - DNA, 34 bp, Homo sapiens
  mature of SEQ ID 4225
cagtattgaatgaaggagaaaagggctttatact

SEQ ID NO: 6474 - DNA, 30 bp, Homo sapiens
  mature of SEQ ID 5402
gccagatacaagaaatgggcccctcgcccc

SEQ ID NO: 6475 - DNA, 20 bp, Homo sapiens
  mature of SEQ ID 5402
gggggctcgtgtctcagtgc

SEQ ID NO: 6476 - DNA, 33 bp, Homo sapiens
  mature of SEQ ID 4701
ggaacaaagccagagggttctcctggcaactgc

SEQ ID NO: 6477 - DNA, 24 bp, Homo sapiens
  mature of SEQ ID 4349
ctcccaggagtttgcagccataat

SEQ ID NO: 6478 - DNA, 20 bp, Homo sapiens
  mature of SEQ ID 4349
attgtggcagccttgactgc

SEQ ID NO: 6479 - DNA, 20 bp, Homo sapiens
  mature of SEQ ID 4816
tggacagtgataaattgaac

SEQ ID NO: 6480 - DNA, 26 bp, Homo sapiens
  mature of SEQ ID 4816
ctgcattctgtggatcagtttgaaca

SEQ ID NO: 6481 - DNA, 34 bp, Homo sapiens
  mature of SEQ ID 4217
tcagcccatttgcaactctgcctctgttctcttg

SEQ ID NO: 6482 - DNA, 21 bp, Homo sapiens
  mature of SEQ ID 4841
gttcttgtcagacattggtga

SEQ ID NO: 6483 - DNA, 20 bp, Homo sapiens
  mature of SEQ ID 4772
aggttgtgtttcattcagcc

SEQ ID NO: 6484 - DNA, 30 bp, Homo sapiens
  mature of SEQ ID 4531
gattcatggagaggcgcaggatgccgagtc

SEQ ID NO: 6485 - DNA, 21 bp, Homo sapiens
  mature of SEQ ID 4531
gagcgcctgcgcctgggaatt

SEQ ID NO: 6486 - DNA, 32 bp, Homo sapiens
  mature of SEQ ID 4410
ccgtcgcgggggccgcggggagctggcccggc

SEQ ID NO: 6487 - DNA, 29 bp, Homo sapiens
  mature of SEQ ID 4410
cgggccgtcgcgggggccgcggggagctg

SEQ ID NO: 6488 - DNA, 23 bp, Homo sapiens
  mature of SEQ ID 4865
tttatgggtagccttgggaataa

SEQ ID NO: 6489 - DNA, 32 bp, Homo sapiens
  mature of SEQ ID 4865
gaggtgcctgcccattgaggtgaattagtggt

SEQ ID NO: 6490 - DNA, 30 bp, Homo sapiens
  mature of SEQ ID 4865
gctcagaggtgcctgcccattgaggtgaat

SEQ ID NO: 6491 - DNA, 25 bp, Homo sapiens
  mature of SEQ ID 5341
ttttgggtgaaaacagtctctgatg

SEQ ID NO: 6492 - DNA, 24 bp, Homo sapiens
  mature of SEQ ID 5341
gggtgtttatcatttaaaaggaac

SEQ ID NO: 6493 - DNA, 28 bp, Homo sapiens
  mature of SEQ ID 5101
cttgataacacatttctcacagaccaca

SEQ ID NO: 6494 - DNA, 19 bp, Homo sapiens
  mature of SEQ ID 4366
acgtttgatgaagaatcag

SEQ ID NO: 6495 - DNA, 20 bp, Homo sapiens
  mature of SEQ ID 5512
gatctttcaagctggcctct

SEQ ID NO: 6496 - DNA, 34 bp, Homo sapiens
  mature of SEQ ID 4106
ggcgagtggccattggaagaatgtggagggctgg

SEQ ID NO: 6497 - DNA, 32 bp, Homo sapiens
  mature of SEQ ID 4106
ccaggtttctttttctttttaatggggcttgt

SEQ ID NO: 6498 - DNA, 19 bp, Homo sapiens
  mature of SEQ ID 4740
ttgtcggttacagcaatgc

SEQ ID NO: 6499 - DNA, 27 bp, Homo sapiens
  mature of SEQ ID 4563
atatatgtacacccattatgttttcag

SEQ ID NO: 6500 - DNA, 21 bp, Homo sapiens
  mature of SEQ ID 4563
ctggtaaacatgacctggaca

SEQ ID NO: 6501 - DNA, 20 bp, Homo sapiens
  mature of SEQ ID 5595
gaaaatggatatcatttgaa

SEQ ID NO: 6502 - DNA, 32 bp, Homo sapiens
  mature of SEQ ID 5595
catccaatttttctattgttcattaagcagca

SEQ ID NO: 6503 - DNA, 18 bp, Homo sapiens
  mature of SEQ ID 4403
aggtcaattttgtcaaac

SEQ ID NO: 6504 - DNA, 19 bp, Homo sapiens
  mature of SEQ ID 4403
gatagagtttataaaacag

SEQ ID NO: 6505 - DNA, 31 bp, Homo sapiens
  mature of SEQ ID 5243
tagctgggcgagatgcagcaggcctctgtcc

SEQ ID NO: 6506 - DNA, 33 bp, Homo sapiens
  mature of SEQ ID 5243
ggcgagatgcagcaggcctctgtcctctgggga

SEQ ID NO: 6507 - DNA, 18 bp, Homo sapiens
  mature of SEQ ID 5243
tgctgcagctggcttctg

SEQ ID NO: 6508 - DNA, 20 bp, Homo sapiens
  mature of SEQ ID 4488
ttattgcaaatatatagtag

SEQ ID NO: 6509 - DNA, 25 bp, Homo sapiens
  mature of SEQ ID 4488
actgctatataatgcaaatggctgc

SEQ ID NO: 6510 - DNA, 30 bp, Homo sapiens
  mature of SEQ ID 5044
aacaggcttattagaagaatgaactaaggt

SEQ ID NO: 6511 - DNA, 33 bp, Homo sapiens
  mature of SEQ ID 5185
ctgtgtcccagccttctgtgtatgcaactggcc

SEQ ID NO: 6512 - DNA, 17 bp, Homo sapiens
  mature of SEQ ID 5185
ggaaagactgaaagggc

SEQ ID NO: 6513 - DNA, 30 bp, Homo sapiens
  mature of SEQ ID 5543
tatatttttcataaagaatcatttcaatcc

SEQ ID NO: 6514 - DNA, 30 bp, Homo sapiens
  mature of SEQ ID 5543
gggtttgaaaatattctattatggtgtgta

SEQ ID NO: 6515 - DNA, 21 bp, Homo sapiens
  mature of SEQ ID 5750
taaaagtattaaaacattgag

SEQ ID NO: 6516 - DNA, 32 bp, Homo sapiens
  mature of SEQ ID 4578
catttcacatccatgaagtaggaattggggct

SEQ ID NO: 6517 - DNA, 35 bp, Homo sapiens
  mature of SEQ ID 4578
catccatgaagtaggaattggggctctgcaccagg

SEQ ID NO: 6518 - DNA, 32 bp, Homo sapiens; identical to SEQ ID NO: 3367
  mature of SEQ ID 4578

SEQ ID NO: 6519 - DNA, 30 bp, Homo sapiens; identical to SEQ ID NO: 3368
  mature of SEQ ID 4578

SEQ ID NO: 6520 - DNA, 31 bp, Homo sapiens
  mature of SEQ ID 4768
tgttttctctattcaacttgtttattcctta

SEQ ID NO: 6521 - DNA, 33 bp, Homo sapiens
  mature of SEQ ID 5418
aatgatatactgtgatgatgaaaacatttattg

SEQ ID NO: 6522 - DNA, 27 bp, Homo sapiens
  mature of SEQ ID 5418
caataaactatgtatcctcattcagat

SEQ ID NO: 6523 - DNA, 23 bp, Homo sapiens
  mature of SEQ ID 5074
aataataattactgtcaggcttc

SEQ ID NO: 6524 - DNA, 25 bp, Homo sapiens
  mature of SEQ ID 4429
ccctttcttgacggctcaataggtc

SEQ ID NO: 6525 - DNA, 26 bp, Homo sapiens
  mature of SEQ ID 4429
ggcccattgagtgcttttaaaagggg

SEQ ID NO: 6526 - DNA, 18 bp, Homo sapiens
  mature of SEQ ID 4819
tttgcagaagcagtggaa

SEQ ID NO: 6527 - DNA, 23 bp, Homo sapiens
  mature of SEQ ID 4819
gagagggccagatctgtggtggc

SEQ ID NO: 6528 - DNA, 27 bp, Homo sapiens
  mature of SEQ ID 5510
tgcattttatgagacagtatttttatt

SEQ ID NO: 6529 - DNA, 32 bp, Homo sapiens
  mature of SEQ ID 4218
catcccctggggccagagtgttgggtggggcc

SEQ ID NO: 6530 - DNA, 29 bp, Homo sapiens
  mature of SEQ ID 4218
ggcacccccacacccacacctgggacttc

SEQ ID NO: 6531 - DNA, 31 bp, Homo sapiens
  mature of SEQ ID 4218
cccccacacccacacctgggacttcccctgg

SEQ ID NO: 6532 - DNA, 20 bp, Homo sapiens
  mature of SEQ ID 4358
gtgtttaatgtttttctgtt

SEQ ID NO: 6533 - DNA, 28 bp, Homo sapiens
  mature of SEQ ID 4358
tcgagggctttgatgatcagggcagagg

SEQ ID NO: 6534 - DNA, 31 bp, Homo sapiens
  mature of SEQ ID 5262
gtcttgttaataatggcaaatcctttcagtc

SEQ ID NO: 6535 - DNA, 31 bp, Homo sapiens
  mature of SEQ ID 5262
gattgacaaggtaataaaagtgttaatgaga

SEQ ID NO: 6536 - DNA, 29 bp, Homo sapiens
  mature of SEQ ID 5262
ctttgattgacaaggtaataaaagtgtta

SEQ ID NO: 6537 - DNA, 23 bp, Homo sapiens
  mature of SEQ ID 4475
aggtgaggggatcagcctttgat

SEQ ID NO: 6538 - DNA, 29 bp, Homo sapiens
  mature of SEQ ID 5480
acctaagaacaaatgtaaaagtaaagatg

SEQ ID NO: 6539 - DNA, 31 bp, Homo sapiens
  mature of SEQ ID 5480
aagaacaaatgtaaaagtaaagatgcagtaa

SEQ ID NO: 6540 - DNA, 20 bp, Homo sapiens
  mature of SEQ ID 5480
ctttgtatttaaatgtttta

SEQ ID NO: 6541 - DNA, 22 bp, Homo sapiens
  mature of SEQ ID 5399
aggatggtaaattggattggtg

SEQ ID NO: 6542 - DNA, 34 bp, Homo sapiens
  mature of SEQ ID 5399
atcatgggatttaaatttatcataaccatgtgta

SEQ ID NO: 6543 - DNA, 31 bp, Homo sapiens
  mature of SEQ ID 5399
caccatatcatgggatttaaatttatcataa

SEQ ID NO: 6544 - DNA, 18 bp, Homo sapiens
  mature of SEQ ID 5149
ggtccctcaactggtctg

SEQ ID NO: 6545 - DNA, 27 bp, Homo sapiens
  mature of SEQ ID 5149
tcttatcggtcctcaggatcaaggacc

SEQ ID NO: 6546 - DNA, 18 bp, Homo sapiens
  mature of SEQ ID 4793
aagagggtccaggtgggt

SEQ ID NO: 6547 - DNA, 19 bp, Homo sapiens
  mature of SEQ ID 4767
aaatattggaaaagtcaag

SEQ ID NO: 6548 - DNA, 23 bp, Homo sapiens
  mature of SEQ ID 4767
tcttggcttttgctcaaaatttg

SEQ ID NO: 6549 - DNA, 19 bp, Homo sapiens
  mature of SEQ ID 4122
ttcgggaagggaagtttga

SEQ ID NO: 6550 - DNA, 20 bp, Homo sapiens
  mature of SEQ ID 4122
gggaccggtttcaagttctt

SEQ ID NO: 6551 - DNA, 22 bp, Homo sapiens
  mature of SEQ ID 4212
tgaattaaggctgaccagagtg

SEQ ID NO: 6552 - DNA, 26 bp, Homo sapiens
  mature of SEQ ID 4212
tccacaaatggaaaactttgagtacc

SEQ ID NO: 6553 - DNA, 32 bp, Homo sapiens
  mature of SEQ ID 5498
agccctgcgcaatctcattgcagatttgcaag

SEQ ID NO: 6554 - DNA, 28 bp, Homo sapiens
  mature of SEQ ID 5374
catccatcactgtttcctttaattgagg

SEQ ID NO: 6555 - DNA, 30 bp, Homo sapiens
  mature of SEQ ID 4296
gcggggggagggtggcggaggccgggtgtc

SEQ ID NO: 6556 - DNA, 23 bp, Homo sapiens
  mature of SEQ ID 4296
gacggccggtcctcgctctctcc

SEQ ID NO: 6557 - DNA, 31 bp, Homo sapiens
  mature of SEQ ID 5048
tttaattcttcaggcttctggtcattgttac

SEQ ID NO: 6558 - DNA, 29 bp, Homo sapiens
  mature of SEQ ID 5048
gcattttaattcttcaggcttctggtcat

SEQ ID NO: 6559 - DNA, 26 bp, Homo sapiens
  mature of SEQ ID 5617
aaaaacttgatgtctactgtgattac

SEQ ID NO: 6560 - DNA, 34 bp, Homo sapiens
  mature of SEQ ID 5571
gtgccaaggaaaatgcggatttggggaaagtgag

SEQ ID NO: 6561 - DNA, 31 bp, Homo sapiens
  mature of SEQ ID 5571
agagctgtgccaaggaaaatgcggatttggg

SEQ ID NO: 6562 - DNA, 29 bp, Homo sapiens
  mature of SEQ ID 5571
ttctcactgcccccgggtacctccctctc

SEQ ID NO: 6563 - DNA, 23 bp, Homo sapiens
  mature of SEQ ID 4452
gaaaatagtcagcaaaatcctta

SEQ ID NO: 6564 - DNA, 27 bp, Homo sapiens
  mature of SEQ ID 5218
taccttgttctttatacattatggaag

SEQ ID NO: 6565 - DNA, 25 bp, Homo sapiens
  mature of SEQ ID 4557
tttcagaagctgctttctgcttgtc

SEQ ID NO: 6566 - DNA, 28 bp, Homo sapiens
  mature of SEQ ID 5140
tcttggagtccaggtcagagccctagag

SEQ ID NO: 6567 - DNA, 18 bp, Homo sapiens
  mature of SEQ ID 5140
atggccaggattcctgga

SEQ ID NO: 6568 - DNA, 26 bp, Homo sapiens
  mature of SEQ ID 4921
agatctgcacatttcttctctttgca

SEQ ID NO: 6569 - DNA, 17 bp, Homo sapiens
  mature of SEQ ID 4921
tgtaaagagtggagaga

SEQ ID NO: 6570 - DNA, 34 bp, Homo sapiens
  mature of SEQ ID 4096
gtgataaaataatagaaaggctttcagaataatg

SEQ ID NO: 6571 - DNA, 22 bp, Homo sapiens
  mature of SEQ ID 4413
cgctgtggctgccgaagccccc

SEQ ID NO: 6572 - DNA, 24 bp, Homo sapiens
  mature of SEQ ID 4903
agtcctaggaatccacagtgaatt

SEQ ID NO: 6573 - DNA, 21 bp, Homo sapiens
  mature of SEQ ID 5735
ttggagaccctggcttcatta

SEQ ID NO: 6574 - DNA, 24 bp, Homo sapiens
  mature of SEQ ID 5594
agttgtcacgttgcattcatgttc

SEQ ID NO: 6575 - DNA, 17 bp, Homo sapiens
  mature of SEQ ID 5594
ggtgttttctgtgctac

SEQ ID NO: 6576 - DNA, 29 bp, Homo sapiens
  mature of SEQ ID 5594
gtgaacttgaaaatagcattgcttcgtgc

SEQ ID NO: 6577 - DNA, 31 bp, Homo sapiens
  mature of SEQ ID 5594
acttgaaaatagcattgcttcgtgcactttg

SEQ ID NO: 6578 - DNA, 26 bp, Homo sapiens
  mature of SEQ ID 5203
gggcagctgcaaaggccagtagcagg

SEQ ID NO: 6579 - DNA, 24 bp, Homo sapiens
  mature of SEQ ID 5203
ttaccctgggcagatcctcaagtc

SEQ ID NO: 6580 - DNA, 18 bp, Homo sapiens
  mature of SEQ ID 4649
ttttttgttcagggtgct

SEQ ID NO: 6581 - DNA, 30 bp, Homo sapiens
  mature of SEQ ID 4649
ctgaaaattgataacaaaccaagtcagcct

SEQ ID NO: 6582 - DNA, 17 bp, Homo sapiens
  mature of SEQ ID 4215
tatgagcctgagtcaga

SEQ ID NO: 6583 - DNA, 20 bp, Homo sapiens
  mature of SEQ ID 4215
gagatattgccaacaatgga

SEQ ID NO: 6584 - DNA, 31 bp, Homo sapiens
  mature of SEQ ID 4215
tctgaaaccagaaatgtgtgttggtaataac

SEQ ID NO: 6585 - DNA, 34 bp, Homo sapiens
  mature of SEQ ID 4856
ttcaatacaccctaaaatggtaaaggacaatgct

SEQ ID NO: 6586 - DNA, 22 bp, Homo sapiens
  mature of SEQ ID 4985
atctgcagtcgctttgtcattt

SEQ ID NO: 6587 - DNA, 22 bp, Homo sapiens
  mature of SEQ ID 4985
gaaggaaacacatcaaagagac

SEQ ID NO: 6588 - DNA, 30 bp, Homo sapiens
  mature of SEQ ID 5730
aaaatcatattaatcattattttaaaaaag

SEQ ID NO: 6589 - DNA, 21 bp, Homo sapiens
  mature of SEQ ID 5730
tttaaaaagtgacagtatgaa

SEQ ID NO: 6590 - DNA, 26 bp, Homo sapiens
  mature of SEQ ID 5495
tcacagatggaagcacccttccaaga

SEQ ID NO: 6591 - DNA, 29 bp, Homo sapiens
  mature of SEQ ID 5495
ggatttattttaaagtgttcttccttctt

SEQ ID NO: 6592 - DNA, 32 bp, Homo sapiens
  mature of SEQ ID 5495
ttattttaaagtgttcttccttcttccaatga

SEQ ID NO: 6593 - DNA, 17 bp, Homo sapiens
  mature of SEQ ID 4638
ttcatcatttatttgct

SEQ ID NO: 6594 - DNA, 33 bp, Homo sapiens
  mature of SEQ ID 4638
tttttaagaggtgaaggaaatgcaaattagcaa

SEQ ID NO: 6595 - DNA, 18 bp, Homo sapiens
  mature of SEQ ID 4207
ggcctgcagccccctggg

SEQ ID NO: 6596 - DNA, 17 bp, Homo sapiens
  mature of SEQ ID 4207
ggaggcagctacccctc

SEQ ID NO: 6597 - DNA, 17 bp, Homo sapiens
  mature of SEQ ID 5328
gaggggctgggagccgc

SEQ ID NO: 6598 - DNA, 20 bp, Homo sapiens
  mature of SEQ ID 4196
ggatcctggacagggccccc

SEQ ID NO: 6599 - DNA, 31 bp, Homo sapiens
  mature of SEQ ID 4196
gggggtcaagaatgcttggcagctccaggtg

SEQ ID NO: 6600 - DNA, 18 bp, Homo sapiens
  mature of SEQ ID 5279
gataaatttccctggtta

SEQ ID NO: 6601 - DNA, 23 bp, Homo sapiens
  mature of SEQ ID 5279
ggaatttaaactgggaccattgt

SEQ ID NO: 6602 - DNA, 17 bp, Homo sapiens
  mature of SEQ ID 5585
gcctctaaatccctcgg

SEQ ID NO: 6603 - DNA, 29 bp, Homo sapiens
  mature of SEQ ID 5585
aagggcagaggccagaaatcattataagc

SEQ ID NO: 6604 - DNA, 31 bp, Homo sapiens
  mature of SEQ ID 5585
gcagaggccagaaatcattataagcttgact

SEQ ID NO: 6605 - DNA, 20 bp, Homo sapiens
  mature of SEQ ID 4492
aggatgggccaaggacaagg

SEQ ID NO: 6606 - DNA, 23 bp, Homo sapiens
  mature of SEQ ID 4492
cctcgcctgctcctcctgtcccc

SEQ ID NO: 6607 - DNA, 31 bp, Homo sapiens
  mature of SEQ ID 4858
aagggtttcacttccgcctggctgcaggaac

SEQ ID NO: 6608 - DNA, 19 bp, Homo sapiens
  mature of SEQ ID 4858
aattggaataatcacagtc

SEQ ID NO: 6609 - DNA, 30 bp, Homo sapiens
  mature of SEQ ID 4394
taaggggtactaaattgtatcctactggct

SEQ ID NO: 6610 - DNA, 33 bp, Homo sapiens
  mature of SEQ ID 4394
ggtactaaattgtatcctactggcttggaggag

SEQ ID NO: 6611 - DNA, 20 bp, Homo sapiens
  mature of SEQ ID 4394
agggaccaattagtgcatta

SEQ ID NO: 6612 - DNA, 23 bp, Homo sapiens
  mature of SEQ ID 4897
gtcccctttccctgcctctttct

SEQ ID NO: 6613 - DNA, 30 bp, Homo sapiens
  mature of SEQ ID 4897
agagcaaggaggacatgatgggggcgtgtt

SEQ ID NO: 6614 - DNA, 32 bp, Homo sapiens
  mature of SEQ ID 4897
aaggaggacatgatgggggcgtgttccttgct

SEQ ID NO: 6615 - DNA, 31 bp, Homo sapiens
  mature of SEQ ID 4088
gctaatcaggcccaaggactacatgaataat

SEQ ID NO: 6616 - DNA, 19 bp, Homo sapiens
  mature of SEQ ID 4259
gtagggacagctctccgag

SEQ ID NO: 6617 - DNA, 30 bp, Homo sapiens
  mature of SEQ ID 4134
gctgtggcattgggtggtctttagcatttt

SEQ ID NO: 6618 - DNA, 27 bp, Homo sapiens
  mature of SEQ ID 4416
ggcaggcaggcagtgcacacttgcgat

SEQ ID NO: 6619 - DNA, 29 bp, Homo sapiens
  mature of SEQ ID 4416
ggcgtcacatggctctgtctccgccccag

SEQ ID NO: 6620 - DNA, 31 bp, Homo sapiens
  mature of SEQ ID 4416
tcacatggctctgtctccgccccagtgggcc

SEQ ID NO: 6621 - DNA, 18 bp, Homo sapiens
  mature of SEQ ID 4968
gtacacagtaattatcac

SEQ ID NO: 6622 - DNA, 21 bp, Homo sapiens
  mature of SEQ ID 4968
tgattaactctgtgattacat

SEQ ID NO: 6623 - DNA, 18 bp, Homo sapiens
  mature of SEQ ID 4968
aaaatcgcagggtgatta

SEQ ID NO: 6624 - DNA, 29 bp, Homo sapiens
  mature of SEQ ID 4733
gcctgagtgagctagtagtattttggcag

SEQ ID NO: 6625 - DNA, 31 bp, Homo sapiens
  mature of SEQ ID 4733
gagtgagctagtagtattttggcaggaccag

SEQ ID NO: 6626 - DNA, 21 bp, Homo sapiens
  mature of SEQ ID 4666
catgcaataaatcttagacta

SEQ ID NO: 6627 - DNA, 29 bp, Homo sapiens
  mature of SEQ ID 5538
ggtgttgctatggatgctgtgctggtgcc

SEQ ID NO: 6628 - DNA, 25 bp, Homo sapiens
  mature of SEQ ID 5538
cggctatatggtggcagagaaccct

SEQ ID NO: 6629 - DNA, 28 bp, Homo sapiens
  mature of SEQ ID 5045
atcttccatacactgagtgctacgatcc

SEQ ID NO: 6630 - DNA, 19 bp, Homo sapiens
  mature of SEQ ID 5045
tgtgagcgagttggaggat

SEQ ID NO: 6631 - DNA, 21 bp, Homo sapiens
  mature of SEQ ID 4114
aatgtgcacaggtgacgccac

SEQ ID NO: 6632 - DNA, 18 bp, Homo sapiens
  mature of SEQ ID 4114
ctggcctggctctgctcc

SEQ ID NO: 6633 - DNA, 29 bp, Homo sapiens
  mature of SEQ ID 4549
ctctgactgagtcctaaccaatccgctac

SEQ ID NO: 6634 - DNA, 17 bp, Homo sapiens
  mature of SEQ ID 4549
gtggctggctgttgtaa

SEQ ID NO: 6635 - DNA, 34 bp, Homo sapiens
  mature of SEQ ID 4804
gtcttgcttctttatggtccatgatgccagctga

SEQ ID NO: 6636 - DNA, 17 bp, Homo sapiens
  mature of SEQ ID 4608
gatgtgtgggcggaaca

SEQ ID NO: 6637 - DNA, 27 bp, Homo sapiens
  mature of SEQ ID 4608
ctgccttaaaaattaaaacgtttacct

SEQ ID NO: 6638 - DNA, 30 bp, Homo sapiens
  mature of SEQ ID 4165
ctgaatgcttttgaaaagttgtagattaca

SEQ ID NO: 6639 - DNA, 31 bp, Homo sapiens
  mature of SEQ ID 4165
tgaaatcacaattaatatcctctaaaagtaa

SEQ ID NO: 6640 - DNA, 25 bp, Homo sapiens
  mature of SEQ ID 4360
catccatccctggagtaaccatctg

SEQ ID NO: 6641 - DNA, 20 bp, Homo sapiens
  mature of SEQ ID 4360
ttattacccaggggcatttc

SEQ ID NO: 6642 - DNA, 19 bp, Homo sapiens
  mature of SEQ ID 5716
gatggagaaggtggcaggc

SEQ ID NO: 6643 - DNA, 31 bp, Homo sapiens
  mature of SEQ ID 5716
gttaactgctgtaattaatgttatgtctcat

SEQ ID NO: 6644 - DNA, 23 bp, Homo sapiens
  mature of SEQ ID 5063
cattggcattttcgaaaaagaga

SEQ ID NO: 6645 - DNA, 22 bp, Homo sapiens
  mature of SEQ ID 5063
ttacaattaagaaatgccaatg

SEQ ID NO: 6646 - DNA, 34 bp, Homo sapiens
  mature of SEQ ID 4786
ggtgatttcctggagccaagcctaggccccccac

SEQ ID NO: 6647 - DNA, 18 bp, Homo sapiens
  mature of SEQ ID 4063
agaggacatatttcttcc

SEQ ID NO: 6648 - DNA, 28 bp, Homo sapiens
  mature of SEQ ID 4063
cagtttgctgacctttatagtgtcctca

SEQ ID NO: 6649 - DNA, 33 bp, Homo sapiens
  mature of SEQ ID 4201
ctgatctatccacaggaaaaccttctaatgttg

SEQ ID NO: 6650 - DNA, 33 bp, Homo sapiens
  mature of SEQ ID 4201
gtgggtctccaagaaggaatatgaggaagacgg

SEQ ID NO: 6651 - DNA, 31 bp, Homo sapiens
  mature of SEQ ID 4201
gaagatgtgggtctccaagaaggaatatgag

SEQ ID NO: 6652 - DNA, 34 bp, Homo sapiens
  mature of SEQ ID 5075
ccttgtctgaccacatctgagaaacttgactttg

SEQ ID NO: 6653 - DNA, 28 bp, Homo sapiens
  mature of SEQ ID 5075
cagattaggtttctcagaaaggtttagg

SEQ ID NO: 6654 - DNA, 29 bp, Homo sapiens
  mature of SEQ ID 4075
atgtccactcaatttatattgtccctttt

SEQ ID NO: 6655 - DNA, 31 bp, Homo sapiens
  mature of SEQ ID 4075
ccactcaatttatattgtcccttttcaatat

SEQ ID NO: 6656 - DNA, 18 bp, Homo sapiens
  mature of SEQ ID 4075
ttttgaaaatggtgatat

SEQ ID NO: 6657 - DNA, 21 bp, Homo sapiens
  mature of SEQ ID 5297
attttgtaggtaactggctag

SEQ ID NO: 6658 - DNA, 27 bp, Homo sapiens
  mature of SEQ ID 5297
caattacctacatggataaaagtgagc

SEQ ID NO: 6659 - DNA, 25 bp, Homo sapiens
  mature of SEQ ID 4902
ttatatcctttccattaaactgtgg

SEQ ID NO: 6660 - DNA, 27 bp, Homo sapiens
  mature of SEQ ID 4902
ggaggtgctaggcaaagatgcagaaac

SEQ ID NO: 6661 - DNA, 31 bp, Homo sapiens
  mature of SEQ ID 4224
gccagtgccagcaaggactctttgtttaagg

SEQ ID NO: 6662 - DNA, 17 bp, Homo sapiens
  mature of SEQ ID 4224
accataagggcaagata

SEQ ID NO: 6663 - DNA, 31 bp, Homo sapiens
  mature of SEQ ID 4960
gcagtcaagcttccacacagacctggggctc

SEQ ID NO: 6664 - DNA, 29 bp, Homo sapiens
  mature of SEQ ID 4960
tcctgcagtcaagcttccacacagacctg

SEQ ID NO: 6665 - DNA, 20 bp, Homo sapiens
  mature of SEQ ID 4680
tttccctggagctgcatttc

SEQ ID NO: 6666 - DNA, 33 bp, Homo sapiens
  mature of SEQ ID 4680
gcaaatttggaagcagaatatttccatgggaaa

SEQ ID NO: 6667 - DNA, 30 bp, Homo sapiens
  mature of SEQ ID 4680
cagaagcaaatttggaagcagaatatttcc

SEQ ID NO: 6668 - DNA, 24 bp, Homo sapiens
  mature of SEQ ID 4127
ctccgcctgctcctcacatccaca

SEQ ID NO: 6669 - DNA, 20 bp, Homo sapiens
  mature of SEQ ID 4127
gagaggaggaaggaaaggcg

SEQ ID NO: 6670 - DNA, 28 bp, Homo sapiens
  mature of SEQ ID 4652
gtgcatgtatgtaataagtatataatat

SEQ ID NO: 6671 - DNA, 20 bp, Homo sapiens
  mature of SEQ ID 4652
atattatatatgactattac

SEQ ID NO: 6672 - DNA, 30 bp, Homo sapiens
  mature of SEQ ID 4049
gccatttgcacaggcccaagtggatttgtg

SEQ ID NO: 6673 - DNA, 33 bp, Homo sapiens
  mature of SEQ ID 4049
ttgcacaggcccaagtggatttgtggagaggag

SEQ ID NO: 6674 - DNA, 20 bp, Homo sapiens
  mature of SEQ ID 4049
cccaagaaatggcttactat

SEQ ID NO: 6675 - DNA, 27 bp, Homo sapiens
  mature of SEQ ID 4700
ccccaggctcccttggcattcctttca

SEQ ID NO: 6676 - DNA, 29 bp, Homo sapiens
  mature of SEQ ID 4700
tgaagccagggaggtgagggcgggtctgg

SEQ ID NO: 6677 - DNA, 19 bp, Homo sapiens
  mature of SEQ ID 5506
tgagaatgggaatttcaag

SEQ ID NO: 6678 - DNA, 31 bp, Homo sapiens
  mature of SEQ ID 4739
ttggctttgaaatgaaaattgggtgactaaa

SEQ ID NO: 6679 - DNA, 29 bp, Homo sapiens
  mature of SEQ ID 4739
gcacttggctttgaaatgaaaattgggtg

SEQ ID NO: 6680 - DNA, 26 bp, Homo sapiens
  mature of SEQ ID 4739
caatttttagaacatagaggtaagat

SEQ ID NO: 6681 - DNA, 23 bp, Homo sapiens
  mature of SEQ ID 4172
atttttgttcacctttagcagtg

SEQ ID NO: 6682 - DNA, 17 bp, Homo sapiens
  mature of SEQ ID 4172
gagttaggtttaaactc

SEQ ID NO: 6683 - DNA, 29 bp, Homo sapiens
  mature of SEQ ID 4249
gatttcttgcagccttttagctgcctggc

SEQ ID NO: 6684 - DNA, 29 bp, Homo sapiens
  mature of SEQ ID 5361
ccaagtttgataattaggagtcctcctcc

SEQ ID NO: 6685 - DNA, 20 bp, Homo sapiens
  mature of SEQ ID 4180
tttatatatatttatagtgt

SEQ ID NO: 6686 - DNA, 18 bp, Homo sapiens
  mature of SEQ ID 4180
gcattgtgaatccaataa

SEQ ID NO: 6687 - DNA, 29 bp, Homo sapiens
  mature of SEQ ID 4537
gtgttgtggtctggcccgcgtgggtggcg

SEQ ID NO: 6688 - DNA, 28 bp, Homo sapiens
  mature of SEQ ID 4061
tgacatgtcccctgagctccaggccagt

SEQ ID NO: 6689 - DNA, 28 bp, Homo sapiens
  mature of SEQ ID 4890
ctgaggctgctttgggtgaggaaggggg

SEQ ID NO: 6690 - DNA, 30 bp, Homo sapiens
  mature of SEQ ID 4890
cctcatccccctcgctcatgctgctgatag

SEQ ID NO: 6691 - DNA, 34 bp, Homo sapiens
  mature of SEQ ID 4837
gtttgctccatcttgtcatcctgcacattttaat

SEQ ID NO: 6692 - DNA, 31 bp, Homo sapiens
  mature of SEQ ID 4837
gttgaagctgtcaggtcctggtggtacaagc

SEQ ID NO: 6693 - DNA, 32 bp, Homo sapiens
  mature of SEQ ID 4333
ctaccattcttctaagatggtggaagagtctc

SEQ ID NO: 6694 - DNA, 29 bp, Homo sapiens
  mature of SEQ ID 4333
ctttctaccattcttctaagatggtggaa

SEQ ID NO: 6695 - DNA, 27 bp, Homo sapiens
  mature of SEQ ID 4037
aaagttacaggaatatttggaactaga

SEQ ID NO: 6696 - DNA, 27 bp, Homo sapiens
  mature of SEQ ID 4037
agacgagtttaattcaagcctgtggct

SEQ ID NO: 6697 - DNA, 22 bp, Homo sapiens
  mature of SEQ ID 4983
ttgcttaattaatcagcctgct

SEQ ID NO: 6698 - DNA, 17 bp, Homo sapiens
  mature of SEQ ID 4983
ggggtgggtgcagagga

SEQ ID NO: 6699 - DNA, 31 bp, Homo sapiens
  mature of SEQ ID 4983
tgagcatctgacccaaccagctcctgatggg

SEQ ID NO: 6700 - DNA, 21 bp, Homo sapiens
  mature of SEQ ID 4756
atccagataacaagaagtaat

SEQ ID NO: 6701 - DNA, 25 bp, Homo sapiens
  mature of SEQ ID 5271
agtaatatttgatgtctgtgatatg

SEQ ID NO: 6702 - DNA, 33 bp, Homo sapiens
  mature of SEQ ID 5676
actgcaggggaagggctggctggggtccccgag

SEQ ID NO: 6703 - DNA, 33 bp, Homo sapiens
  mature of SEQ ID 5577
gatttatgagagggaaaagtaggtcaaatttgg

SEQ ID NO: 6704 - DNA, 30 bp, Homo sapiens
  mature of SEQ ID 5577
ccaaatggcctctctccatctctttaaatc

SEQ ID NO: 6705 - DNA, 27 bp, Homo sapiens
  mature of SEQ ID 4517
gaccttttcatttcctttctacaagat

SEQ ID NO: 6706 - DNA, 27 bp, Homo sapiens
  mature of SEQ ID 4517
aggtcttgacttctgctgaaaagctaa

SEQ ID NO: 6707 - DNA, 20 bp, Homo sapiens
  mature of SEQ ID 5366
gtgctaatcatagaaaatca

SEQ ID NO: 6708 - DNA, 21 bp, Homo sapiens
  mature of SEQ ID 5366
aggctgctttatgatttgcat

SEQ ID NO: 6709 - DNA, 17 bp, Homo sapiens
  mature of SEQ ID 5176
ttaccttgattaattgt

SEQ ID NO: 6710 - DNA, 19 bp, Homo sapiens
  mature of SEQ ID 5176
agacaattaaggaagatgg

SEQ ID NO: 6711 - DNA, 32 bp, Homo sapiens
  mature of SEQ ID 4978
ttcggctccacgcaccgtaaacattctgtggc

SEQ ID NO: 6712 - DNA, 30 bp, Homo sapiens
  mature of SEQ ID 4978
ttcgtttcggctccacgcaccgtaaacatt

SEQ ID NO: 6713 - DNA, 23 bp, Homo sapiens
  mature of SEQ ID 4978
gccatgaatgagtacagtgtttg

SEQ ID NO: 6714 - DNA, 18 bp, Homo sapiens
  mature of SEQ ID 4978
actagtcaacaagatgga

SEQ ID NO: 6715 - DNA, 32 bp, Homo sapiens
  mature of SEQ ID 5640
gcaaagctgaaacttaaaggaattggtggaag

SEQ ID NO: 6716 - DNA, 30 bp, Homo sapiens
  mature of SEQ ID 5640
cggttgcaaagctgaaacttaaaggaattg

SEQ ID NO: 6717 - DNA, 23 bp, Homo sapiens
  mature of SEQ ID 5640
cttccaagaaaccaaagtctttg

SEQ ID NO: 6718 - DNA, 29 bp, Homo sapiens
  mature of SEQ ID 5644
tggtgaagagaagggggcttccgaggaca

SEQ ID NO: 6719 - DNA, 30 bp, Homo sapiens
  mature of SEQ ID 4190
tgtaattctttcatatttctatctcaatga

SEQ ID NO: 6720 - DNA, 33 bp, Homo sapiens
  mature of SEQ ID 4190
tgtcagaaatagatggaagatgacaatttatat

SEQ ID NO: 6721 - DNA, 33 bp, Homo sapiens
  mature of SEQ ID 4835
gtgtctgtccatctgtctgggactggttttgtc

SEQ ID NO: 6722 - DNA, 31 bp, Homo sapiens
  mature of SEQ ID 4912
gtctctagagttttaagttccaattgcacct

SEQ ID NO: 6723 - DNA, 29 bp, Homo sapiens
  mature of SEQ ID 4912
cactgtctctagagttttaagttccaatt

SEQ ID NO: 6724 - DNA, 25 bp, Homo sapiens
  mature of SEQ ID 5650
gttccagtttagagcctgccttgcc

SEQ ID NO: 6725 - DNA, 31 bp, Homo sapiens
  mature of SEQ ID 5026
gcatctgtcctggttcccacactctggcctc

SEQ ID NO: 6726 - DNA, 20 bp, Homo sapiens
  mature of SEQ ID 5397
cgagttctttctgcagagct

SEQ ID NO: 6727 - DNA, 25 bp, Homo sapiens
  mature of SEQ ID 5397
tcccagggtgatcctcttctgcttc

SEQ ID NO: 6728 - DNA, 19 bp, Homo sapiens
  mature of SEQ ID 4211
agggaatgacagactcggg

SEQ ID NO: 6729 - DNA, 26 bp, Homo sapiens
  mature of SEQ ID 4211
cctgagcctgtaattacttcaggagt

SEQ ID NO: 6730 - DNA, 18 bp, Homo sapiens
  mature of SEQ ID 4243
aggaagagagctgcttgg

SEQ ID NO: 6731 - DNA, 26 bp, Homo sapiens
  mature of SEQ ID 4243
aggtgggccagaacctccagttgttc

SEQ ID NO: 6732 - DNA, 23 bp, Homo sapiens
  mature of SEQ ID 4721
gacaggcagggcgggaggtggac

SEQ ID NO: 6733 - DNA, 18 bp, Homo sapiens
  mature of SEQ ID 4670
agacaaaggatatattcc

SEQ ID NO: 6734 - DNA, 22 bp, Homo sapiens
  mature of SEQ ID 4670
cttgatatgtaggacttcggct

SEQ ID NO: 6735 - DNA, 29 bp, Homo sapiens
  mature of SEQ ID 4788
ctgctgcccgctggagccctagtggctcc

SEQ ID NO: 6736 - DNA, 31 bp, Homo sapiens
  mature of SEQ ID 4788
tgcccgctggagccctagtggctccctcgct

SEQ ID NO: 6737 - DNA, 28 bp, Homo sapiens
  mature of SEQ ID 4788
atggccgcagcagctgcagctgcagcag

SEQ ID NO: 6738 - DNA, 31 bp, Homo sapiens
  mature of SEQ ID 4377
caccatcaaatgttttccacacagaataggc

SEQ ID NO: 6739 - DNA, 29 bp, Homo sapiens
  mature of SEQ ID 4377
taaccaccatcaaatgttttccacacaga

SEQ ID NO: 6740 - DNA, 32 bp, Homo sapiens
  mature of SEQ ID 4339
gggtgccaattagggatcattatacatttctt

SEQ ID NO: 6741 - DNA, 27 bp, Homo sapiens
  mature of SEQ ID 4339
aagaaatgcttaagtgtttaattggca

SEQ ID NO: 6742 - DNA, 26 bp, Homo sapiens
  mature of SEQ ID 5567
taaggaagccagtggcctgcagtgga

SEQ ID NO: 6743 - DNA, 29 bp, Homo sapiens
  mature of SEQ ID 5567
tgtctccttaggcaaaaagctgctttgga

SEQ ID NO: 6744 - DNA, 25 bp, Homo sapiens
  mature of SEQ ID 5066
agtgtctcctgctctggttagcccc

SEQ ID NO: 6745 - DNA, 29 bp, Homo sapiens
  mature of SEQ ID 4742
aagatttattggttcaagagttattgatc

SEQ ID NO: 6746 - DNA, 32 bp, Homo sapiens
  mature of SEQ ID 4742
tttattggttcaagagttattgatcatgggca

SEQ ID NO: 6747 - DNA, 29 bp, Homo sapiens
  mature of SEQ ID 4814
ggagattgttgtcatggtgtttctatgct

SEQ ID NO: 6748 - DNA, 33 bp, Homo sapiens
  mature of SEQ ID 4814
agcaggaagtactagaaatcttgaagagtctcc

SEQ ID NO: 6749 - DNA, 24 bp, Homo sapiens
  mature of SEQ ID 5461
ctcaggcctgggatttatggaaga

SEQ ID NO: 6750 - DNA, 31 bp, Homo sapiens
  mature of SEQ ID 5461
ggatctccttggttttcacactgtagatgat

SEQ ID NO: 6751 - DNA, 34 bp, Homo sapiens
  mature of SEQ ID 5461
ccttggttttcacactgtagatgatagggttgag

SEQ ID NO: 6752 - DNA, 34 bp, Homo sapiens
  mature of SEQ ID 5339
gaaattaatacaagagactggcataatctcacct

SEQ ID NO: 6753 - DNA, 32 bp, Homo sapiens
  mature of SEQ ID 5339
actataggaaattaatacaagagactggcata

SEQ ID NO: 6754 - DNA, 18 bp, Homo sapiens
  mature of SEQ ID 4798
tatttgcttaactgaggt

SEQ ID NO: 6755 - DNA, 23 bp, Homo sapiens
  mature of SEQ ID 4798
aggattttaggttgccatggaga

SEQ ID NO: 6756 - DNA, 18 bp, Homo sapiens
  mature of SEQ ID 4779
tgctcattgtaatttact

SEQ ID NO: 6757 - DNA, 29 bp, Homo sapiens
  mature of SEQ ID 4779
cttgcttaatagcatagcatatatcattt

SEQ ID NO: 6758 - DNA, 31 bp, Homo sapiens
  mature of SEQ ID 4779
cttaatagcatagcatatatcatttatactg

SEQ ID NO: 6759 - DNA, 20 bp, Homo sapiens
  mature of SEQ ID 4779
cagtaaaatgcattccctct

SEQ ID NO: 6760 - DNA, 26 bp, Homo sapiens
  mature of SEQ ID 5275
ttgccatcacatccgcctgggaagcc

SEQ ID NO: 6761 - DNA, 17 bp, Homo sapiens
  mature of SEQ ID 5275
aagtgccccccaggagg

SEQ ID NO: 6762 - DNA, 34 bp, Homo sapiens
  mature of SEQ ID 4345
gaggtatatttaagcaaagaaaggcattccacgg

SEQ ID NO: 6763 - DNA, 32 bp, Homo sapiens
  mature of SEQ ID 4345
gagcacagaggtatatttaagcaaagaaaggc

SEQ ID NO: 6764 - DNA, 33 bp, Homo sapiens
  mature of SEQ ID 4345
cttccttccttcagctgaattataccaacatgt

SEQ ID NO: 6765 - DNA, 31 bp, Homo sapiens
  mature of SEQ ID 4345
ccgggacttccttccttcagctgaattatac

SEQ ID NO: 6766 - DNA, 18 bp, Homo sapiens
  mature of SEQ ID 4535
aggctgaaaggagttcac

SEQ ID NO: 6767 - DNA, 20 bp, Homo sapiens
  mature of SEQ ID 4535
gctcctttacaactttattt

SEQ ID NO: 6768 - DNA, 25 bp, Homo sapiens
  mature of SEQ ID 5725
ccataactcattttcagagtcaact

SEQ ID NO: 6769 - DNA, 32 bp, Homo sapiens
  mature of SEQ ID 5725
aagtttctgaggaatcctgggtacttgtaatt

SEQ ID NO: 6770 - DNA, 26 bp, Homo sapiens
  mature of SEQ ID 4655
gcaggcgctgccctcgggggcctggg

SEQ ID NO: 6771 - DNA, 27 bp, Homo sapiens
  mature of SEQ ID 4655
cccaggcaaccggggcggggccggggc

SEQ ID NO: 6772 - DNA, 20 bp, Homo sapiens
  mature of SEQ ID 4962
agttttgaaggactatcctt

SEQ ID NO: 6773 - DNA, 18 bp, Homo sapiens
  mature of SEQ ID 4962
tttagaccatatacaagg

SEQ ID NO: 6774 - DNA, 27 bp, Homo sapiens
  mature of SEQ ID 5413
tttagctttcagaagctgaaaggtttt

SEQ ID NO: 6775 - DNA, 17 bp, Homo sapiens
  mature of SEQ ID 5413
gagttatatttgaattt

SEQ ID NO: 6776 - DNA, 20 bp, Homo sapiens
  mature of SEQ ID 4499
aataaatatttgatgcaggt

SEQ ID NO: 6777 - DNA, 28 bp, Homo sapiens
  mature of SEQ ID 4499
gatattatgttttaatatattgttagct

SEQ ID NO: 6778 - DNA, 17 bp, Homo sapiens
  mature of SEQ ID 4499
agcaaatttactattgg

SEQ ID NO: 6779 - DNA, 33 bp, Homo sapiens
  mature of SEQ ID 5671
tgcatagtttcttggtttaaaatactgtgaaag

SEQ ID NO: 6780 - DNA, 31 bp, Homo sapiens
  mature of SEQ ID 5671
tatttttgcatagtttcttggtttaaaatac

SEQ ID NO: 6781 - DNA, 29 bp, Homo sapiens
  mature of SEQ ID 5671
tgtggaacctgttactatgacatcaaaaa

SEQ ID NO: 6782 - DNA, 24 bp, Homo sapiens
  mature of SEQ ID 4862
ccctttgggaaggtcaccaacctc

SEQ ID NO: 6783 - DNA, 20 bp, Homo sapiens
  mature of SEQ ID 5079
agctggttgtaagtctgcac

SEQ ID NO: 6784 - DNA, 23 bp, Homo sapiens
  mature of SEQ ID 4839
tatttgttaactgctcgcctttg

SEQ ID NO: 6785 - DNA, 33 bp, Homo sapiens
  mature of SEQ ID 4839
tcactcaatggatcccttgtgattggtggacaa

SEQ ID NO: 6786 - DNA, 24 bp, Homo sapiens
  mature of SEQ ID 5379
attttttaaggtggccggaggctt

SEQ ID NO: 6787 - DNA, 28 bp, Homo sapiens
  mature of SEQ ID 4281
cgcttattgtaacagacacatcagattg

SEQ ID NO: 6788 - DNA, 32 bp, Homo sapiens
  mature of SEQ ID 5638
attcaagaagctataaactttaaatatattaa

SEQ ID NO: 6789 - DNA, 24 bp, Homo sapiens
  mature of SEQ ID 5638
taccttttgaagggtattttggat

SEQ ID NO: 6790 - DNA, 28 bp, Homo sapiens
  mature of SEQ ID 5502
gtgtttatttaatgttgataaatatgac

SEQ ID NO: 6791 - DNA, 23 bp, Homo sapiens
  mature of SEQ ID 5258
gacggcgtctgaggtggaagggg

SEQ ID NO: 6792 - DNA, 25 bp, Homo sapiens
  mature of SEQ ID 5130
tcagatagataatgatgtgccttgg

SEQ ID NO: 6793 - DNA, 25 bp, Homo sapiens
  mature of SEQ ID 5130
ctgttctgaagacaatgttgttaag

SEQ ID NO: 6794 - DNA, 29 bp, Homo sapiens
  mature of SEQ ID 4380
gagccggggagttgacagtttagaccatt

SEQ ID NO: 6795 - DNA, 32 bp, Homo sapiens
  mature of SEQ ID 4380
cggggagttgacagtttagaccattaggctta

SEQ ID NO: 6796 - DNA, 31 bp, Homo sapiens
  mature of SEQ ID 4380
tgagcagtaatgactgaggtgtgagccactt

SEQ ID NO: 6797 - DNA, 17 bp, Homo sapiens
  mature of SEQ ID 5727
tctctctcgctgtcccc

SEQ ID NO: 6798 - DNA, 31 bp, Homo sapiens
  mature of SEQ ID 5727
ccctgtgtccccctcagccataggggtcacc

SEQ ID NO: 6799 - DNA, 25 bp, Homo sapiens
  mature of SEQ ID 5674
ataatgatttcttatgctcattttt

SEQ ID NO: 6800 - DNA, 17 bp, Homo sapiens
  mature of SEQ ID 5674
atgaggaatcattatga

SEQ ID NO: 6801 - DNA, 21 bp, Homo sapiens
  mature of SEQ ID 4723
ggtcttatttacataattgat

SEQ ID NO: 6802 - DNA, 33 bp, Homo sapiens
  mature of SEQ ID 4361
agggtggaaagcaaaggcacactcgggtttatg

SEQ ID NO: 6803 - DNA, 18 bp, Homo sapiens
  mature of SEQ ID 5184
tgtgcttggtctggctct

SEQ ID NO: 6804 - DNA, 31 bp, Homo sapiens
  mature of SEQ ID 4914
ttgatggaatgctgtcacccagccatcaaac

SEQ ID NO: 6805 - DNA, 21 bp, Homo sapiens
  mature of SEQ ID 5592
ctctccagccgttcttcacct

SEQ ID NO: 6806 - DNA, 29 bp, Homo sapiens
  mature of SEQ ID 5592
aacacctggagcccccacagcacagagga

SEQ ID NO: 6807 - DNA, 32 bp, Homo sapiens
  mature of SEQ ID 5592
cctggagcccccacagcacagaggaggggact

SEQ ID NO: 6808 - DNA, 32 bp, Homo sapiens
  mature of SEQ ID 4864
tcttgtaaagtcattcaagtgagaagagtaga

SEQ ID NO: 6809 - DNA, 29 bp, Homo sapiens
  mature of SEQ ID 4864
aatgtcttgtaaagtcattcaagtgagaa

SEQ ID NO: 6810 - DNA, 17 bp, Homo sapiens
  mature of SEQ ID 4864
ctgccacaaggagcatt

SEQ ID NO: 6811 - DNA, 27 bp, Homo sapiens
  mature of SEQ ID 4981
tagtggctcctgggataagatgctaaa

SEQ ID NO: 6812 - DNA, 25 bp, Homo sapiens
  mature of SEQ ID 4981
atagctgttgatagctcaggaacta

SEQ ID NO: 6813 - DNA, 31 bp, Homo sapiens
  mature of SEQ ID 5428
tttggcttcaggatggagggaagcacagaaa

SEQ ID NO: 6814 - DNA, 30 bp, Homo sapiens
  mature of SEQ ID 5428
agatttctgactgcttgatcctcctgtgtg

SEQ ID NO: 6815 - DNA, 21 bp, Homo sapiens
  mature of SEQ ID 4288
ttcctacagtgttaactatgg

SEQ ID NO: 6816 - DNA, 19 bp, Homo sapiens
  mature of SEQ ID 4288
ccatgtttaaaaagaaatg

SEQ ID NO: 6817 - DNA, 32 bp, Homo sapiens
  mature of SEQ ID 4288
ctgtagcgtgactctgtaatggaatatcatgg

SEQ ID NO: 6818 - DNA, 21 bp, Homo sapiens
  mature of SEQ ID 4586
ctaatgccctgacttgcccgg

SEQ ID NO: 6819 - DNA, 33 bp, Homo sapiens
  mature of SEQ ID 4586
tcaggagcttaggggctttccctggtttctgct

SEQ ID NO: 6820 - DNA, 31 bp, Homo sapiens
  mature of SEQ ID 4586
catagatcaggagcttaggggctttccctgg

SEQ ID NO: 6821 - DNA, 19 bp, Homo sapiens
  mature of SEQ ID 4755
gatgcaaataatagtttaa

SEQ ID NO: 6822 - DNA, 30 bp, Homo sapiens
  mature of SEQ ID 4755
aaagatataaattgtattgcatatgcatta

SEQ ID NO: 6823 - DNA, 28 bp, Homo sapiens
  mature of SEQ ID 5741
gtgggtttagtctgggaaaacaaaactt

SEQ ID NO: 6824 - DNA, 25 bp, Homo sapiens
  mature of SEQ ID 5741
agacagtgggctaggaagacccaga

SEQ ID NO: 6825 - DNA, 24 bp, Homo sapiens
  mature of SEQ ID 4411
atctagattgctccagccagatgg

SEQ ID NO: 6826 - DNA, 17 bp, Homo sapiens
  mature of SEQ ID 4411
tggccttggtggaacta

SEQ ID NO: 6827 - DNA, 21 bp, Homo sapiens
  mature of SEQ ID 4411
ctcaaagatagaaccaggcca

SEQ ID NO: 6828 - DNA, 17 bp, Homo sapiens
  mature of SEQ ID 4771
gtgctgcagcaggatgc

SEQ ID NO: 6829 - DNA, 20 bp, Homo sapiens
  mature of SEQ ID 4771
agctgcctggtgcgcaaccc

SEQ ID NO: 6830 - DNA, 26 bp, Homo sapiens
  mature of SEQ ID 5479
tgcagggcctttaaacttggggaagc

SEQ ID NO: 6831 - DNA, 33 bp, Homo sapiens
  mature of SEQ ID 5479
tgttatttggtatatcaagccatctaaaagcac

SEQ ID NO: 6832 - DNA, 30 bp, Homo sapiens
  mature of SEQ ID 5479
tatattgttatttggtatatcaagccatct

SEQ ID NO: 6833 - DNA, 18 bp, Homo sapiens
  mature of SEQ ID 4633
gttcttaattataatgta

SEQ ID NO: 6834 - DNA, 24 bp, Homo sapiens
  mature of SEQ ID 4633
tgtttttggacagtataaatgata

SEQ ID NO: 6835 - DNA, 27 bp, Homo sapiens
  mature of SEQ ID 4136
tcttttacagcctcattacacttgcca

SEQ ID NO: 6836 - DNA, 34 bp, Homo sapiens
  mature of SEQ ID 4136
tgggtgttaggcttgactgaggagggtggaagga

SEQ ID NO: 6837 - DNA, 25 bp, Homo sapiens
  mature of SEQ ID 4078
tccttgagcactgcaaggacggagt

SEQ ID NO: 6838 - DNA, 23 bp, Homo sapiens
  mature of SEQ ID 4078
ttaaataagtcaaaacacagtgc

SEQ ID NO: 6839 - DNA, 22 bp, Homo sapiens
  mature of SEQ ID 5740
ctgggaaggcctctggggctgg

SEQ ID NO: 6840 - DNA, 32 bp, Homo sapiens
  mature of SEQ ID 5740
tattcccccggtcagcctcaagggcttctggg

SEQ ID NO: 6841 - DNA, 32 bp, Homo sapiens
  mature of SEQ ID 4753
agctagcatggctatttttgcctctgcctcat

SEQ ID NO: 6842 - DNA, 18 bp, Homo sapiens
  mature of SEQ ID 4753
aaagggcagaggtgagtg

SEQ ID NO: 6843 - DNA, 25 bp, Homo sapiens
  mature of SEQ ID 4753
ctataaattcacacagctgctggct

SEQ ID NO: 6844 - DNA, 27 bp, Homo sapiens
  mature of SEQ ID 4650
gttgctcaaaatttctagcccttatcc

SEQ ID NO: 6845 - DNA, 22 bp, Homo sapiens
  mature of SEQ ID 5329
ttttagtaacccacatatcttt

SEQ ID NO: 6846 - DNA, 24 bp, Homo sapiens
  mature of SEQ ID 5329
cctgggtaaaggcttattgatttt

SEQ ID NO: 6847 - DNA, 20 bp, Homo sapiens
  mature of SEQ ID 4065
ctcctaaaatgtctgcaaaa

SEQ ID NO: 6848 - DNA, 23 bp, Homo sapiens
  mature of SEQ ID 4065
taacagccctcccctgaagaatg

SEQ ID NO: 6849 - DNA, 33 bp, Homo sapiens
  mature of SEQ ID 5711
tgggccacctgaggcactttcattaaaggcttt

SEQ ID NO: 6850 - DNA, 31 bp, Homo sapiens
  mature of SEQ ID 5711
ggggttgttttataaaatgagaaggtggtgg

SEQ ID NO: 6851 - DNA, 35 bp, Homo sapiens
  mature of SEQ ID 5525
tgatgtttagttttccaaaaatatttatgtcagtc

SEQ ID NO: 6852 - DNA, 32 bp, Homo sapiens
  mature of SEQ ID 5525
tcaaccttgatgtttagttttccaaaaatatt

SEQ ID NO: 6853 - DNA, 28 bp, Homo sapiens
  mature of SEQ ID 5157
aggaactgattacatctgagcctctggc

SEQ ID NO: 6854 - DNA, 30 bp, Homo sapiens
  mature of SEQ ID 5157
gaagaaggtggaggtggtgtagttgggcct

SEQ ID NO: 6855 - DNA, 19 bp, Homo sapiens
  mature of SEQ ID 4068
gtctgtgcagtgaatacca

SEQ ID NO: 6856 - DNA, 17 bp, Homo sapiens
  mature of SEQ ID 4068
gaacatgacggattatg

SEQ ID NO: 6857 - DNA, 17 bp, Homo sapiens
  mature of SEQ ID 4068
attcactacatctgctg

SEQ ID NO: 6858 - DNA, 17 bp, Homo sapiens
  mature of SEQ ID 4256
acgatggcaccgtagtg

SEQ ID NO: 6859 - DNA, 21 bp, Homo sapiens
  mature of SEQ ID 4256
gtcgcccatcattgccaaatg

SEQ ID NO: 6860 - DNA, 24 bp, Homo sapiens
  mature of SEQ ID 4812
taatttaagcctgcatactgcatt

SEQ ID NO: 6861 - DNA, 29 bp, Homo sapiens
  mature of SEQ ID 4812
ttctcctgcagttaaatgaggctcaatta

SEQ ID NO: 6862 - DNA, 18 bp, Homo sapiens
  mature of SEQ ID 5440
cctagattagtttatgga

SEQ ID NO: 6863 - DNA, 29 bp, Homo sapiens
  mature of SEQ ID 5440
tgattagggctctgcattatttccagcat

SEQ ID NO: 6864 - DNA, 31 bp, Homo sapiens
  mature of SEQ ID 5440
tagggctctgcattatttccagcataatttg

SEQ ID NO: 6865 - DNA, 34 bp, Homo sapiens
  mature of SEQ ID 4898
aaaagataaaatgttctgggatggatttaagatc

SEQ ID NO: 6866 - DNA, 31 bp, Homo sapiens
  mature of SEQ ID 4898
aaaatcaaaagataaaatgttctgggatgga

SEQ ID NO: 6867 - DNA, 34 bp, Homo sapiens
  mature of SEQ ID 4431
ggcaccatcactgagggcgccatgggccacctgc

SEQ ID NO: 6868 - DNA, 25 bp, Homo sapiens
  mature of SEQ ID 4431
gcagcatgagcccactggctcccag

SEQ ID NO: 6869 - DNA, 19 bp, Homo sapiens
  mature of SEQ ID 4534
gataacttcttgaaaaaga

SEQ ID NO: 6870 - DNA, 29 bp, Homo sapiens
  mature of SEQ ID 4534
aatatatattgtaaagaagggatattaag

SEQ ID NO: 6871 - DNA, 22 bp, Homo sapiens
  mature of SEQ ID 4691
gactgcaggtgttagtaaatgt

SEQ ID NO: 6872 - DNA, 33 bp, Homo sapiens
  mature of SEQ ID 4966
acaatgggcggcgcgagcgtccaggcgctgggc

SEQ ID NO: 6873 - DNA, 17 bp, Homo sapiens
  mature of SEQ ID 4934
aagtcctttgtgaactg

SEQ ID NO: 6874 - DNA, 19 bp, Homo sapiens
  mature of SEQ ID 4934
ttcagtctttacattagtg

SEQ ID NO: 6875 - DNA, 25 bp, Homo sapiens
  mature of SEQ ID 5121
caccatgctgtccatgacgtacagc

SEQ ID NO: 6876 - DNA, 31 bp, Homo sapiens
  mature of SEQ ID 5121
gtctgcggagcgtgagcagcaggtgccactc

SEQ ID NO: 6877 - DNA, 32 bp, Homo sapiens; identical to SEQ ID NO: 5981
  mature of SEQ ID 4116

SEQ ID NO: 6878 - DNA, 33 bp, Homo sapiens; identical to SEQ ID NO: 5980
  mature of SEQ ID 4116

SEQ ID NO: 6879 - DNA, 21 bp, Homo sapiens
  mature of SEQ ID 5394
ccttcttctcactcctcacct

SEQ ID NO: 6880 - DNA, 17 bp, Homo sapiens
  mature of SEQ ID 5394
ggacatagccacagggg

SEQ ID NO: 6881 - DNA, 34 bp, Homo sapiens
  mature of SEQ ID 5394
aggtgaggagcaggatggggcctctgggggtgtg

SEQ ID NO: 6882 - DNA, 27 bp, Homo sapiens
  mature of SEQ ID 5668
gatcacgggagttgttgattcagactt

SEQ ID NO: 6883 - DNA, 34 bp, Homo sapiens
  mature of SEQ ID 5668
tatgagttgaagtcttcaataagcttaaatgatc

SEQ ID NO: 6884 - DNA, 19 bp, Homo sapiens
  mature of SEQ ID 5304
aagcattcagacatgtaag

SEQ ID NO: 6885 - DNA, 25 bp, Homo sapiens
  mature of SEQ ID 5304
tacaggttctatttggagtttggat

SEQ ID NO: 6886 - DNA, 30 bp, Homo sapiens
  mature of SEQ ID 5129
tgcattcaaaacaattctgctgtgatagta

SEQ ID NO: 6887 - DNA, 23 bp, Homo sapiens
  mature of SEQ ID 4151
tagcagcttagtcaggggtggct

SEQ ID NO: 6888 - DNA, 33 bp, Homo sapiens
  mature of SEQ ID 4151
aaagctgggagttctttctggcaagggttggtg

SEQ ID NO: 6889 - DNA, 31 bp, Homo sapiens
  mature of SEQ ID 4151
gcatgaaaagctgggagttctttctggcaag

SEQ ID NO: 6890 - DNA, 23 bp, Homo sapiens
  mature of SEQ ID 4551
acagcaaatgttccttcaaattg

SEQ ID NO: 6891 - DNA, 26 bp, Homo sapiens
  mature of SEQ ID 4551
gcctaatttggaggaaaaacgttggc

SEQ ID NO: 6892 - DNA, 32 bp, Homo sapiens
  mature of SEQ ID 5499
gtggtttattaattgagacagagaggcagatg

SEQ ID NO: 6893 - DNA, 26 bp, Homo sapiens
  mature of SEQ ID 5499
atctttctgtctgtccagtgaaccac

SEQ ID NO: 6894 - DNA, 18 bp, Homo sapiens
  mature of SEQ ID 5639
ggctgattgaccccatag

SEQ ID NO: 6895 - DNA, 25 bp, Homo sapiens
  mature of SEQ ID 4067
tttttggatcaaatagcatgagggg

SEQ ID NO: 6896 - DNA, 24 bp, Homo sapiens
  mature of SEQ ID 4067
ctctcctttgctttgtaaattcaa

SEQ ID NO: 6897 - DNA, 28 bp, Homo sapiens
  mature of SEQ ID 5575
caattggcgagttataggaagcgctcac

SEQ ID NO: 6898 - DNA, 30 bp, Homo sapiens
  mature of SEQ ID 4999
gctgaggaggggccccagcagcccccgaag

SEQ ID NO: 6899 - DNA, 31 bp, Homo sapiens
  mature of SEQ ID 4999
tagcagcagcgggggtggctgggaagtgaaa

SEQ ID NO: 6900 - DNA, 22 bp, Homo sapiens
  mature of SEQ ID 5610
gggattaaccctggcagtaaag

SEQ ID NO: 6901 - DNA, 20 bp, Homo sapiens
  mature of SEQ ID 5610
tacttaaataataatgaaaa

SEQ ID NO: 6902 - DNA, 18 bp, Homo sapiens
  mature of SEQ ID 5382
agttataaaaatatgctt

SEQ ID NO: 6903 - DNA, 17 bp, Homo sapiens
  mature of SEQ ID 5382
catttgcctgagaaaaa

SEQ ID NO: 6904 - DNA, 33 bp, Homo sapiens
  mature of SEQ ID 5438
aacggtacttagaggtaactagaaaattgtggc

SEQ ID NO: 6905 - DNA, 31 bp, Homo sapiens
  mature of SEQ ID 5438
tattccaacggtacttagaggtaactagaaa

SEQ ID NO: 6906 - DNA, 30 bp, Homo sapiens
  mature of SEQ ID 4736
ggaggcctcacagacagatcaccactatct

SEQ ID NO: 6907 - DNA, 23 bp, Homo sapiens
  mature of SEQ ID 4736
tgctagctggcttctgagaaatg

SEQ ID NO: 6908 - DNA, 17 bp, Homo sapiens
  mature of SEQ ID 4736
ctggcaggtggcctggt

SEQ ID NO: 6909 - DNA, 27 bp, Homo sapiens
  mature of SEQ ID 4572
ggcgagcattttcatgcttggttaact

SEQ ID NO: 6910 - DNA, 31 bp, Homo sapiens
  mature of SEQ ID 4572
agtttttcaagactgaaatggtctttaatga

SEQ ID NO: 6911 - DNA, 34 bp, Homo sapiens
  mature of SEQ ID 4572
tcaagactgaaatggtctttaatgaagcaagcca

SEQ ID NO: 6912 - DNA, 34 bp, Homo sapiens
  mature of SEQ ID 5658
agctcaagagtctagttcctattctacggcattt

SEQ ID NO: 6913 - DNA, 32 bp, Homo sapiens
  mature of SEQ ID 5658
ccaatttagctcaagagtctagttcctattct

SEQ ID NO: 6914 - DNA, 17 bp, Homo sapiens
  mature of SEQ ID 5658
tggattctgagctgtgg

SEQ ID NO: 6915 - DNA, 25 bp, Homo sapiens
  mature of SEQ ID 4597
gcaggtgctggctgccaggttccct

SEQ ID NO: 6916 - DNA, 18 bp, Homo sapiens
  mature of SEQ ID 5043
gtgggggtacgcttcacc

SEQ ID NO: 6917 - DNA, 31 bp, Homo sapiens
  mature of SEQ ID 4986
tagggttagtgttgatgtatttccattactt

SEQ ID NO: 6918 - DNA, 35 bp, Homo sapiens
  mature of SEQ ID 4690
gaacacattcccactgggtttctactgattgtgaa

SEQ ID NO: 6919 - DNA, 33 bp, Homo sapiens
  mature of SEQ ID 4690
atttcgatgaacacattcccactgggtttctac

SEQ ID NO: 6920 - DNA, 26 bp, Homo sapiens
  mature of SEQ ID 4690
gtatttctcaaggggaatgtttcatg

SEQ ID NO: 6921 - DNA, 31 bp, Homo sapiens
  mature of SEQ ID 5387
tgatgtgggaccagttgtgctgggccacggc

SEQ ID NO: 6922 - DNA, 29 bp, Homo sapiens
  mature of SEQ ID 5387
cgatgagctggcactgggacttctggtcc

SEQ ID NO: 6923 - DNA, 31 bp, Homo sapiens
  mature of SEQ ID 5387
gagctggcactgggacttctggtcctgcagc

SEQ ID NO: 6924 - DNA, 24 bp, Homo sapiens
  mature of SEQ ID 4101
gtaggcctcacaagcctcctgcag

SEQ ID NO: 6925 - DNA, 24 bp, Homo sapiens
  mature of SEQ ID 4246
ctttcctttattttcaagagctca

SEQ ID NO: 6926 - DNA, 19 bp, Homo sapiens
  mature of SEQ ID 4246
ttcttgaaacttaatcatt

SEQ ID NO: 6927 - DNA, 23 bp, Homo sapiens
  mature of SEQ ID 5756
gtaattaagatatctgaaccatc

SEQ ID NO: 6928 - DNA, 32 bp, Homo sapiens
  mature of SEQ ID 5699
cttgtggagaggataatttgaagggctacagg

SEQ ID NO: 6929 - DNA, 29 bp, Homo sapiens
  mature of SEQ ID 5699
ctaccttgtggagaggataatttgaaggg

SEQ ID NO: 6930 - DNA, 21 bp, Homo sapiens
  mature of SEQ ID 5699
tccactttctacaaaatgggt

SEQ ID NO: 6931 - DNA, 25 bp, Homo sapiens
  mature of SEQ ID 5517
tgcctactttggaggagtgggaggc

SEQ ID NO: 6932 - DNA, 30 bp, Homo sapiens
  mature of SEQ ID 5435
acatccctcccaatctgcaaaaactctact

SEQ ID NO: 6933 - DNA, 21 bp, Homo sapiens
  mature of SEQ ID 5435
agtggagtttctgcaaaggtc

SEQ ID NO: 6934 - DNA, 31 bp, Homo sapiens
  mature of SEQ ID 4762
gtgcgggggatgatgtcacgcggccggaagt

SEQ ID NO: 6935 - DNA, 25 bp, Homo sapiens
  mature of SEQ ID 4762
gcttctctccgcacacacgtcaccc

SEQ ID NO: 6936 - DNA, 34 bp, Homo sapiens
  mature of SEQ ID 5334
tcctgaattatctttacgagatgatttcggcttt

SEQ ID NO: 6937 - DNA, 21 bp, Homo sapiens
  mature of SEQ ID 5334
ttatctgtgaatttctcagga

SEQ ID NO: 6938 - DNA, 33 bp, Homo sapiens
  mature of SEQ ID 4594
ccagctgctcccaccaggggccgtttgaacctc

SEQ ID NO: 6939 - DNA, 17 bp, Homo sapiens
  mature of SEQ ID 4594
gaggaatggaggctgct

SEQ ID NO: 6940 - DNA, 20 bp, Homo sapiens
  mature of SEQ ID 5626
tgggtagtgaaatccagtta

SEQ ID NO: 6941 - DNA, 20 bp, Homo sapiens
  mature of SEQ ID 5626
agaacagaggaaattcatta

SEQ ID NO: 6942 - DNA, 27 bp, Homo sapiens
  mature of SEQ ID 4115
ggcagcgcagccggcggggcgcggtgc

SEQ ID NO: 6943 - DNA, 19 bp, Homo sapiens
  mature of SEQ ID 4115
aagcccgcgccccgcccgg

SEQ ID NO: 6944 - DNA, 25 bp, Homo sapiens
  mature of SEQ ID 5059
ctcaagagaagtcaatatctacttt

SEQ ID NO: 6945 - DNA, 23 bp, Homo sapiens
  mature of SEQ ID 5024
tgatgtcttatgagtgcattttg

SEQ ID NO: 6946 - DNA, 27 bp, Homo sapiens
  mature of SEQ ID 5024
ttgtaaaataatattcgcatacaaatt

SEQ ID NO: 6947 - DNA, 21 bp, Homo sapiens
  mature of SEQ ID 4505
cttctggagagaacgtgggca

SEQ ID NO: 6948 - DNA, 18 bp, Homo sapiens
  mature of SEQ ID 4869
tgaaaactgaacactgag

SEQ ID NO: 6949 - DNA, 18 bp, Homo sapiens
  mature of SEQ ID 5427
gtatttttgttgccctga

SEQ ID NO: 6950 - DNA, 26 bp, Homo sapiens
  mature of SEQ ID 5427
ggttcagaagtcagggtaaatgacat

SEQ ID NO: 6951 - DNA, 17 bp, Homo sapiens
  mature of SEQ ID 4402
ccctctatgtccaatca

SEQ ID NO: 6952 - DNA, 33 bp, Homo sapiens
  mature of SEQ ID 4402
gcagcaggtggcttttaatgagatcttgaaaca

SEQ ID NO: 6953 - DNA, 30 bp, Homo sapiens
  mature of SEQ ID 4402
ttaaggcagcaggtggcttttaatgagatc

SEQ ID NO: 6954 - DNA, 21 bp, Homo sapiens
  mature of SEQ ID 4092
tcttaactgtttttattgctg

SEQ ID NO: 6955 - DNA, 22 bp, Homo sapiens
  mature of SEQ ID 4092
ttggaatatttccacttgcaat

SEQ ID NO: 6956 - DNA, 19 bp, Homo sapiens
  mature of SEQ ID 4732
gactctcacttcctgcccc

SEQ ID NO: 6957 - DNA, 17 bp, Homo sapiens
  mature of SEQ ID 4732
cagtgcctagggagccc

SEQ ID NO: 6958 - DNA, 32 bp, Homo sapiens
  mature of SEQ ID 5061
gccaggagtttgctgtgttttctgtatggggc

SEQ ID NO: 6959 - DNA, 29 bp, Homo sapiens
  mature of SEQ ID 5061
cagggccaggagtttgctgtgttttctgt

SEQ ID NO: 6960 - DNA, 25 bp, Homo sapiens
  mature of SEQ ID 5061
gcaaccagggaggaaatcgtgagct

SEQ ID NO: 6961 - DNA, 32 bp, Homo sapiens
  mature of SEQ ID 4383
ggctccatgacctacagcgcctctctgcccct

SEQ ID NO: 6962 - DNA, 35 bp, Homo sapiens
  mature of SEQ ID 4383
tgacctacagcgcctctctgcccctcccgctcagc

SEQ ID NO: 6963 - DNA, 20 bp, Homo sapiens
  mature of SEQ ID 4303
ggagggagtgtgtgcgcgcg

SEQ ID NO: 6964 - DNA, 23 bp, Homo sapiens
  mature of SEQ ID 4309
tccctctggatcggcacctctct

SEQ ID NO: 6965 - DNA, 26 bp, Homo sapiens
  mature of SEQ ID 4309
ggagagtgtgtacatgagaaagaaaa

SEQ ID NO: 6966 - DNA, 18 bp, Homo sapiens
  mature of SEQ ID 4603
gatcaacctgataatatt

SEQ ID NO: 6967 - DNA, 34 bp, Homo sapiens
  mature of SEQ ID 4603
gagccaatggcatctatgaggcaatctaccatgg

SEQ ID NO: 6968 - DNA, 33 bp, Homo sapiens
  mature of SEQ ID 4422
cgctgactatgtccatgtcagagcaggcttcca

SEQ ID NO: 6969 - DNA, 30 bp, Homo sapiens
  mature of SEQ ID 4150
gtaagtgtggctcaagattatgtttcagaa

SEQ ID NO: 6970 - DNA, 33 bp, Homo sapiens
  mature of SEQ ID 4150
tgtggctcaagattatgtttcagaaaatacaga

SEQ ID NO: 6971 - DNA, 17 bp, Homo sapiens
  mature of SEQ ID 4278
cacattccggagatccc

SEQ ID NO: 6972 - DNA, 17 bp, Homo sapiens
  mature of SEQ ID 4278
ccccggtgcctggattc

SEQ ID NO: 6973 - DNA, 33 bp, Homo sapiens
  mature of SEQ ID 4278
gggatttgtggagggaggaaggatataaaaggg

SEQ ID NO: 6974 - DNA, 19 bp, Homo sapiens
  mature of SEQ ID 5431
cttttcccctccaagcccc

SEQ ID NO: 6975 - DNA, 32 bp, Homo sapiens
  mature of SEQ ID 5431
ggcctttagtggagggaaacagggctaagatt

SEQ ID NO: 6976 - DNA, 22 bp, Homo sapiens
  mature of SEQ ID 4163
gacggcagctggctgcttcctc

SEQ ID NO: 6977 - DNA, 19 bp, Homo sapiens
  mature of SEQ ID 4163
tgggggagccagcgccctc

SEQ ID NO: 6978 - DNA, 22 bp, Homo sapiens
  mature of SEQ ID 5058
ggatgctgtaacactgaccctc

SEQ ID NO: 6979 - DNA, 17 bp, Homo sapiens
  mature of SEQ ID 5058
gagacagctactttaga

SEQ ID NO: 6980 - DNA, 25 bp, Homo sapiens
  mature of SEQ ID 4846
ccctgtctttattacattttccacc

SEQ ID NO: 6981 - DNA, 31 bp, Homo sapiens
  mature of SEQ ID 4846
tgattaggccaacactgtgaagatgtattat

SEQ ID NO: 6982 - DNA, 19 bp, Homo sapiens
  mature of SEQ ID 4182
ttaattataacaattgtgc

SEQ ID NO: 6983 - DNA, 31 bp, Homo sapiens
  mature of SEQ ID 4182
tgatcacatatgttatgctaattatataatt

SEQ ID NO: 6984 - DNA, 18 bp, Homo sapiens
  mature of SEQ ID 4167
cttcgggtcactgggcga

SEQ ID NO: 6985 - DNA, 19 bp, Homo sapiens
  mature of SEQ ID 4167
cggtcaacaggactggaag

SEQ ID NO: 6986 - DNA, 33 bp, Homo sapiens
  mature of SEQ ID 5280
tcccctggaaactcctccggggctgggggaggc

SEQ ID NO: 6987 - DNA, 19 bp, Homo sapiens
  mature of SEQ ID 4592
cttcagagttggaaacgag

SEQ ID NO: 6988 - DNA, 31 bp, Homo sapiens
  mature of SEQ ID 5145
ggattcaagtgcatttttatctcaaagtgga

SEQ ID NO: 6989 - DNA, 33 bp, Homo sapiens
  mature of SEQ ID 5145
aagtgcatttttatctcaaagtggaagaatctg

SEQ ID NO: 6990 - DNA, 17 bp, Homo sapiens
  mature of SEQ ID 5729
ggagatgtttttgtctt

SEQ ID NO: 6991 - DNA, 32 bp, Homo sapiens
  mature of SEQ ID 5729
gaaaaactaatatatttgagatgttccatttt

SEQ ID NO: 6992 - DNA, 29 bp, Homo sapiens
  mature of SEQ ID 5729
aagagaaaaactaatatatttgagatgtt

SEQ ID NO: 6993 - DNA, 27 bp, Homo sapiens
  mature of SEQ ID 4089
gatatgagtcttttcctttcccatttt

SEQ ID NO: 6994 - DNA, 32 bp, Homo sapiens
  mature of SEQ ID 4373
tagttgggctcggctccattgagagctttggt

SEQ ID NO: 6995 - DNA, 17 bp, Homo sapiens
  mature of SEQ ID 4368
ggcccttccagtaccat

SEQ ID NO: 6996 - DNA, 26 bp, Homo sapiens
  mature of SEQ ID 4526
aggcactctaagtaggaatttccatg

SEQ ID NO: 6997 - DNA, 22 bp, Homo sapiens
  mature of SEQ ID 5747
gagtcaaattttggcctttgac

SEQ ID NO: 6998 - DNA, 26 bp, Homo sapiens
  mature of SEQ ID 5747
agtgacaaaggttggaattctgattc

SEQ ID NO: 6999 - DNA, 28 bp, Homo sapiens
  mature of SEQ ID 4769
ctatggtcgtgggcctcaacaagggcca

SEQ ID NO: 7000 - DNA, 23 bp, Homo sapiens
  mature of SEQ ID 4457
ggaggcggggccggcgggagccc

SEQ ID NO: 7001 - DNA, 22 bp, Homo sapiens
  mature of SEQ ID 4457
gggctcccggctgggtcccgct

SEQ ID NO: 7002 - DNA, 17 bp, Homo sapiens
  mature of SEQ ID 5612
acagtaattacatggtt

SEQ ID NO: 7003 - DNA, 23 bp, Homo sapiens
  mature of SEQ ID 5612
gtaattatgtaataaatgcatat

SEQ ID NO: 7004 - DNA, 21 bp, Homo sapiens
  mature of SEQ ID 4553
gggcaatgaggtggaaggagt

SEQ ID NO: 7005 - DNA, 24 bp, Homo sapiens
  mature of SEQ ID 4553
tttcattcattcattgaattctct

SEQ ID NO: 7006 - DNA, 18 bp, Homo sapiens
  mature of SEQ ID 4553
ggagagttagagatgaaa

SEQ ID NO: 7007 - DNA, 22 bp, Homo sapiens
  mature of SEQ ID 5588
gaggctggagaaaatgatgaaa

SEQ ID NO: 7008 - DNA, 34 bp, Homo sapiens
  mature of SEQ ID 4057
tctctgccaccctgggaaaatgtctgttttcata

SEQ ID NO: 7009 - DNA, 17 bp, Homo sapiens
  mature of SEQ ID 4495
ctgggttccagttagca

SEQ ID NO: 7010 - DNA, 24 bp, Homo sapiens
  mature of SEQ ID 5661
ttttacctggagatctaaactaag

SEQ ID NO: 7011 - DNA, 26 bp, Homo sapiens
  mature of SEQ ID 5661
ctttgcttggtgtcatttaagtctcc

SEQ ID NO: 7012 - DNA, 21 bp, Homo sapiens
  mature of SEQ ID 4945
ggggagcggttcctcctccgc

SEQ ID NO: 7013 - DNA, 29 bp, Homo sapiens
  mature of SEQ ID 4945
gcgggggagaccgctcctgacccccaccc

SEQ ID NO: 7014 - DNA, 32 bp, Homo sapiens
  mature of SEQ ID 4945
gggagaccgctcctgacccccaccccttcgtg

SEQ ID NO: 7015 - DNA, 32 bp, Homo sapiens
  mature of SEQ ID 4972
caacatcacattacagatctatgacttacagg

SEQ ID NO: 7016 - DNA, 30 bp, Homo sapiens
  mature of SEQ ID 4972
catttcaacatcacattacagatctatgac

SEQ ID NO: 7017 - DNA, 17 bp, Homo sapiens
  mature of SEQ ID 4972
tctgtcatttaaatatg

SEQ ID NO: 7018 - DNA, 25 bp, Homo sapiens
  mature of SEQ ID 4972
ggtgagctgatggctgaattggatt

SEQ ID NO: 7019 - DNA, 31 bp, Homo sapiens
  mature of SEQ ID 4175
accagcctgaaacaaaatggaggtgagacct

SEQ ID NO: 7020 - DNA, 29 bp, Homo sapiens
  mature of SEQ ID 4175
gattaccagcctgaaacaaaatggaggtg

SEQ ID NO: 7021 - DNA, 21 bp, Homo sapiens
  mature of SEQ ID 4175
cctccattttgtgggctaatt

SEQ ID NO: 7022 - DNA, 25 bp, Homo sapiens
  mature of SEQ ID 4904
ggatttaaacatcttagctgctcta

SEQ ID NO: 7023 - DNA, 26 bp, Homo sapiens
  mature of SEQ ID 4904
tagagaaactaggagatcaagccaag

SEQ ID NO: 7024 - DNA, 29 bp, Homo sapiens
  mature of SEQ ID 4938
cttgagccgcaggcgggcacgggcctggg

SEQ ID NO: 7025 - DNA, 22 bp, Homo sapiens
  mature of SEQ ID 4938
cccaggccttgcctcgagctgc

SEQ ID NO: 7026 - DNA, 18 bp, Homo sapiens
  mature of SEQ ID 4323
ctcctcgctcaaaaaccg

SEQ ID NO: 7027 - DNA, 17 bp, Homo sapiens
  mature of SEQ ID 4206
ttgttactgaatctgaa

SEQ ID NO: 7028 - DNA, 26 bp, Homo sapiens
  mature of SEQ ID 5734
caatataatggtttgaaaagtaattt

SEQ ID NO: 7029 - DNA, 25 bp, Homo sapiens
  mature of SEQ ID 5622
aaatgagctactcagcattaatgtg

SEQ ID NO: 7030 - DNA, 22 bp, Homo sapiens
  mature of SEQ ID 5622
tactcttctgcttaaaagtagt

SEQ ID NO: 7031 - DNA, 19 bp, Homo sapiens
  mature of SEQ ID 4108
tgggttaggtcctgctgag

SEQ ID NO: 7032 - DNA, 18 bp, Homo sapiens
  mature of SEQ ID 4108
caattcattgtactggtt

SEQ ID NO: 7033 - DNA, 18 bp, Homo sapiens
  mature of SEQ ID 4644
taatttattgtttcacat

SEQ ID NO: 7034 - DNA, 22 bp, Homo sapiens
  mature of SEQ ID 4644
gggaatgagttagtggtaaata

SEQ ID NO: 7035 - DNA, 17 bp, Homo sapiens
  mature of SEQ ID 4644
ttaatcaaacaatagat

SEQ ID NO: 7036 - DNA, 21 bp, Homo sapiens
  mature of SEQ ID 4668
gtctaaggctaacatggtgat

SEQ ID NO: 7037 - DNA, 21 bp, Homo sapiens
  mature of SEQ ID 4668
aatgaccattgtattagcttc

SEQ ID NO: 7038 - DNA, 21 bp, Homo sapiens
  mature of SEQ ID 4770
ttataatattgcaaagtttat

SEQ ID NO: 7039 - DNA, 25 bp, Homo sapiens
  mature of SEQ ID 5268
agtcttcggcaaaacatttatcttt

SEQ ID NO: 7040 - DNA, 21 bp, Homo sapiens
  mature of SEQ ID 5268
aaatatgttttgtaaaccact

SEQ ID NO: 7041 - DNA, 20 bp, Homo sapiens
  mature of SEQ ID 4055
aaaaattgaaaaactgtcac

SEQ ID NO: 7042 - DNA, 20 bp, Homo sapiens
  mature of SEQ ID 4055
taagttttaacacttctgct

SEQ ID NO: 7043 - DNA, 31 bp, Homo sapiens
  mature of SEQ ID 5150
aaaaagcacagctgctgatgctcatggaaag

SEQ ID NO: 7044 - DNA, 30 bp, Homo sapiens
  mature of SEQ ID 4100
ttctcccagctataactctgctggcactaa

SEQ ID NO: 7045 - DNA, 22 bp, Homo sapiens
  mature of SEQ ID 4679
ggattgttggcaggccagcctg

SEQ ID NO: 7046 - DNA, 30 bp, Homo sapiens
  mature of SEQ ID 4397
ccttctaagaaaggatttcttggcaggagt

SEQ ID NO: 7047 - DNA, 25 bp, Homo sapiens
  mature of SEQ ID 4397
atttttccagaaccttttttacgga

SEQ ID NO: 7048 - DNA, 30 bp, Homo sapiens
  mature of SEQ ID 4895
gccctttgtgtaataatctgccaacattca

SEQ ID NO: 7049 - DNA, 20 bp, Homo sapiens
  mature of SEQ ID 4895
tgtacccattctactgtggc

SEQ ID NO: 7050 - DNA, 17 bp, Homo sapiens
  mature of SEQ ID 4895
ctccattacgactgggt

SEQ ID NO: 7051 - DNA, 32 bp, Homo sapiens
  mature of SEQ ID 4792
ttgtcaatcaaatatcttgttatacacaggtc

SEQ ID NO: 7052 - DNA, 32 bp, Homo sapiens
  mature of SEQ ID 4792
tcaaatttaagtataataagatataagattga

SEQ ID NO: 7053 - DNA, 19 bp, Homo sapiens
  mature of SEQ ID 4371
gggagggggaatgttggcc

SEQ ID NO: 7054 - DNA, 23 bp, Homo sapiens
  mature of SEQ ID 4749
cgtgctctttggttttgtctggg

SEQ ID NO: 7055 - DNA, 29 bp, Homo sapiens
  mature of SEQ ID 4119
aattttgtaacttgtccaaattttacatt

SEQ ID NO: 7056 - DNA, 29 bp, Homo sapiens
  mature of SEQ ID 4119
aaatgtccaatgataactacaaatttaaa

SEQ ID NO: 7057 - DNA, 31 bp, Homo sapiens
  mature of SEQ ID 4119
gtccaatgataactacaaatttaaatgagaa

SEQ ID NO: 7058 - DNA, 26 bp, Homo sapiens
  mature of SEQ ID 4915
tcagctaaatcaggacacaaagctac

SEQ ID NO: 7059 - DNA, 22 bp, Homo sapiens
  mature of SEQ ID 4915
gggcagtgcagccaatgctctg

SEQ ID NO: 7060 - DNA, 19 bp, Homo sapiens
  mature of SEQ ID 4178
ccctccagcgagacaaaag

SEQ ID NO: 7061 - DNA, 33 bp, Homo sapiens
  mature of SEQ ID 4178
aaatgttataatcacctggaggctggcacgcgg

SEQ ID NO: 7062 - DNA, 18 bp, Homo sapiens
  mature of SEQ ID 5516
acttgaatggtttcctta

SEQ ID NO: 7063 - DNA, 23 bp, Homo sapiens
  mature of SEQ ID 5657
agtcagattgtatcacagaagag

SEQ ID NO: 7064 - DNA, 30 bp, Homo sapiens
  mature of SEQ ID 5657
cttttctatggtgacagtgattgcccttga

SEQ ID NO: 7065 - DNA, 18 bp, Homo sapiens
  mature of SEQ ID 4313
tattccagatgaatttac

SEQ ID NO: 7066 - DNA, 25 bp, Homo sapiens
  mature of SEQ ID 5065
agtccaataaatgtcagttaaactt

SEQ ID NO: 7067 - DNA, 33 bp, Homo sapiens
  mature of SEQ ID 5065
gaaaccccttaagttaggagtggaacacagaca

SEQ ID NO: 7068 - DNA, 20 bp, Homo sapiens
  mature of SEQ ID 4417
gaatcgcctgcctgtcaaac

SEQ ID NO: 7069 - DNA, 29 bp, Homo sapiens
  mature of SEQ ID 5132
gtgctgttaagtggagagaaaagtgtttg

SEQ ID NO: 7070 - DNA, 31 bp, Homo sapiens
  mature of SEQ ID 5132
caaattattattttctccatgagatgaagcc

SEQ ID NO: 7071 - DNA, 20 bp, Homo sapiens
  mature of SEQ ID 4232
gtagctctgcgaggtggcag

SEQ ID NO: 7072 - DNA, 24 bp, Homo sapiens
  mature of SEQ ID 4232
gttgttctgctgcacgcccgcatt

SEQ ID NO: 7073 - DNA, 31 bp, Homo sapiens
  mature of SEQ ID 4758
tgatgagagcctattgtgaataacaggattt

SEQ ID NO: 7074 - DNA, 27 bp, Homo sapiens
  mature of SEQ ID 5336
cttggccattgtcaagctgtgagtcag

SEQ ID NO: 7075 - DNA, 24 bp, Homo sapiens
  mature of SEQ ID 5336
acgggtttaaggctggcactggca

SEQ ID NO: 7076 - DNA, 26 bp, Homo sapiens
  mature of SEQ ID 4694
tgtgccagatgtatacacagctgtac

SEQ ID NO: 7077 - DNA, 26 bp, Homo sapiens
  mature of SEQ ID 4694
cgctgtggacccagctgctgactgta

SEQ ID NO: 7078 - DNA, 22 bp, Homo sapiens
  mature of SEQ ID 4077
gtccatggaaaaagtggagagt

SEQ ID NO: 7079 - DNA, 17 bp, Homo sapiens
  mature of SEQ ID 4077
gaggggccagctctggc

SEQ ID NO: 7080 - DNA, 20 bp, Homo sapiens
  mature of SEQ ID 5539
agagatggatgatttattgc

SEQ ID NO: 7081 - DNA, 27 bp, Homo sapiens
  mature of SEQ ID 5539
gttttaaattaaaagctattctcacaa

SEQ ID NO: 7082 - DNA, 20 bp, Homo sapiens
  mature of SEQ ID 5037
gcccttgctccccctcaccc

SEQ ID NO: 7083 - DNA, 29 bp, Homo sapiens
  mature of SEQ ID 5037
gtttggcgggttggggcgggctccaggag

SEQ ID NO: 7084 - DNA, 31 bp, Homo sapiens
  mature of SEQ ID 5037
ggcgggttggggcgggctccaggaggcagtt

SEQ ID NO: 7085 - DNA, 21 bp, Homo sapiens
  mature of SEQ ID 5360
aaagaactgcacttcagactt

SEQ ID NO: 7086 - DNA, 33 bp, Homo sapiens
  mature of SEQ ID 5360
tgaggtacttgatatgcggtgtgtttcttctct

SEQ ID NO: 7087 - DNA, 28 bp, Homo sapiens
  mature of SEQ ID 4965
gctgggagaaattccatcctcctaccag

SEQ ID NO: 7088 - DNA, 19 bp, Homo sapiens
  mature of SEQ ID 4965
ctggcaggatggatggtaa

SEQ ID NO: 7089 - DNA, 22 bp, Homo sapiens
  mature of SEQ ID 4312
gcagggttgggggagttggggt

SEQ ID NO: 7090 - DNA, 24 bp, Homo sapiens
  mature of SEQ ID 4312
cctgcctccaccacccatccctgc

SEQ ID NO: 7091 - DNA, 32 bp, Homo sapiens
  mature of SEQ ID 5284
cctctgtgacatccaggcctgtgctctcggct

SEQ ID NO: 7092 - DNA, 19 bp, Homo sapiens
  mature of SEQ ID 5284
gggggcaggctttggcccc

SEQ ID NO: 7093 - DNA, 19 bp, Homo sapiens
  mature of SEQ ID 5705
aaatgaggttattggatta

SEQ ID NO: 7094 - DNA, 30 bp, Homo sapiens
  mature of SEQ ID 4046
tggtatcataatttgcagtgattcatctgt

SEQ ID NO: 7095 - DNA, 27 bp, Homo sapiens
  mature of SEQ ID 4046
atggatgagtcgtcaattttgataaga

SEQ ID NO: 7096 - DNA, 33 bp, Homo sapiens
  mature of SEQ ID 4086
actccagtgacagagcagaagttctggggactg

SEQ ID NO: 7097 - DNA, 31 bp, Homo sapiens
  mature of SEQ ID 4086
gtgggcactccagtgacagagcagaagttct

SEQ ID NO: 7098 - DNA, 25 bp, Homo sapiens
  mature of SEQ ID 4671
gccttgatcaagcccaccagcagcc

SEQ ID NO: 7099 - DNA, 34 bp, Homo sapiens
  mature of SEQ ID 4501
gtagtcacatcacggattcaattttctcttaaga

SEQ ID NO: 7100 - DNA, 21 bp, Homo sapiens
  mature of SEQ ID 4855
atgccaaatgcacattagcac

SEQ ID NO: 7101 - DNA, 23 bp, Homo sapiens
  mature of SEQ ID 4855
tgattggtatcttaaaaggatgc

SEQ ID NO: 7102 - DNA, 28 bp, Homo sapiens
  mature of SEQ ID 5442
gctccttaatccggatctccagctcgca

SEQ ID NO: 7103 - DNA, 32 bp, Homo sapiens
  mature of SEQ ID 5022
gggtatgtcactaagaacctgctggcaacccc

SEQ ID NO: 7104 - DNA, 29 bp, Homo sapiens
  mature of SEQ ID 5022
aactgggtatgtcactaagaacctgctgg

SEQ ID NO: 7105 - DNA, 33 bp, Homo sapiens
  mature of SEQ ID 5022
gggcaaggaggttcttgctgtgatcatggcagt

SEQ ID NO: 7106 - DNA, 30 bp, Homo sapiens
  mature of SEQ ID 5022
gtggtgggcaaggaggttcttgctgtgatc

SEQ ID NO: 7107 - DNA, 20 bp, Homo sapiens
  mature of SEQ ID 4240
ggatgccttcgggtgaaggt

SEQ ID NO: 7108 - DNA, 19 bp, Homo sapiens
  mature of SEQ ID 4240
ggcttcctggggtgagttg

SEQ ID NO: 7109 - DNA, 18 bp, Homo sapiens
  mature of SEQ ID 4240
gaagcaatttaagcattt

SEQ ID NO: 7110 - DNA, 34 bp, Homo sapiens
  mature of SEQ ID 5141
taattgatctagcagtcttgtggcaatgtaatat

SEQ ID NO: 7111 - DNA, 19 bp, Homo sapiens
  mature of SEQ ID 5109
ccagccatgttgttagatg

SEQ ID NO: 7112 - DNA, 19 bp, Homo sapiens
  mature of SEQ ID 5109
tgtgaatatctgatcgatg

SEQ ID NO: 7113 - DNA, 29 bp, Homo sapiens
  mature of SEQ ID 4370
ttttgcttgtcaggtttggatagaatata

SEQ ID NO: 7114 - DNA, 32 bp, Homo sapiens
  mature of SEQ ID 4370
attgtcctttctataagcttgtcactgcaaaa

SEQ ID NO: 7115 - DNA, 31 bp, Homo sapiens
  mature of SEQ ID 5296
ggcagagggcaagggaggggtggtattaaac

SEQ ID NO: 7116 - DNA, 29 bp, Homo sapiens
  mature of SEQ ID 5296
tggaggcagagggcaagggaggggtggta

SEQ ID NO: 7117 - DNA, 31 bp, Homo sapiens
  mature of SEQ ID 4153
ggagcttttaagacacagcaaatatatttct

SEQ ID NO: 7118 - DNA, 26 bp, Homo sapiens
  mature of SEQ ID 4153
gagaagtttatttgcttgtttaagag

SEQ ID NO: 7119 - DNA, 34 bp, Homo sapiens
  mature of SEQ ID 4905
tccacatgcgtgtggtagcccaaggctttgttgt

SEQ ID NO: 7120 - DNA, 28 bp, Homo sapiens
  mature of SEQ ID 4905
ttggtatgggctattccatgtatcggga

SEQ ID NO: 7121 - DNA, 17 bp, Homo sapiens
  mature of SEQ ID 5608
ggatgggggtccgccca

SEQ ID NO: 7122 - DNA, 25 bp, Homo sapiens
  mature of SEQ ID 5608
ctggggaaggcaaggactcggggac

SEQ ID NO: 7123 - DNA, 21 bp, Homo sapiens
  mature of SEQ ID 5503
gatgaccagtttccaaatgtc

SEQ ID NO: 7124 - DNA, 18 bp, Homo sapiens
  mature of SEQ ID 5503
gctgccttttcattaata

SEQ ID NO: 7125 - DNA, 26 bp, Homo sapiens
  mature of SEQ ID 4705
tggtggaggaagtttcttgagatgag

SEQ ID NO: 7126 - DNA, 17 bp, Homo sapiens
  mature of SEQ ID 5467
agcaaactattctgtga

SEQ ID NO: 7127 - DNA, 29 bp, Homo sapiens
  mature of SEQ ID 5215
agaagatattgtattggtttcctgcccag

SEQ ID NO: 7128 - DNA, 31 bp, Homo sapiens
  mature of SEQ ID 5215
tcatttcctgattatgcagttagctattctt

SEQ ID NO: 7129 - DNA, 17 bp, Homo sapiens
  mature of SEQ ID 5474
gtgtggctcatggctgg

SEQ ID NO: 7130 - DNA, 32 bp, Homo sapiens
  mature of SEQ ID 5474
aatgtcttcccatctcacgccgtgaggagctc

SEQ ID NO: 7131 - DNA, 23 bp, Homo sapiens
  mature of SEQ ID 4848
ggagaccgtcgccttctggtggg

SEQ ID NO: 7132 - DNA, 22 bp, Homo sapiens
  mature of SEQ ID 4848
tctaccatgaggggaagtctct

SEQ ID NO: 7133 - DNA, 32 bp, Homo sapiens
  mature of SEQ ID 4532
gcagtctgtcttggtaaaatctgtgtttcttt

SEQ ID NO: 7134 - DNA, 30 bp, Homo sapiens
  mature of SEQ ID 4532
ctgtggcagtctgtcttggtaaaatctgtg

SEQ ID NO: 7135 - DNA, 33 bp, Homo sapiens
  mature of SEQ ID 4532
tggactctgaggcacagctttgataaagaaatc

SEQ ID NO: 7136 - DNA, 24 bp, Homo sapiens
  mature of SEQ ID 5652
cgaactggagctggctggggagct

SEQ ID NO: 7137 - DNA, 30 bp, Homo sapiens
  mature of SEQ ID 5652
agcacctcgccagagccgagggctgcctgc

SEQ ID NO: 7138 - DNA, 23 bp, Homo sapiens
  mature of SEQ ID 4261
atgtagtttgttttataattatt

SEQ ID NO: 7139 - DNA, 29 bp, Homo sapiens
  mature of SEQ ID 4261
aatacaacagagatgaatggataagattg

SEQ ID NO: 7140 - DNA, 31 bp, Homo sapiens
  mature of SEQ ID 4261
caacagagatgaatggataagattgctacat

SEQ ID NO: 7141 - DNA, 23 bp, Homo sapiens
  mature of SEQ ID 4464
cctgctccacccaagctccctcc

SEQ ID NO: 7142 - DNA, 20 bp, Homo sapiens
  mature of SEQ ID 4464
ggatgcagggagctgggggc

SEQ ID NO: 7143 - DNA, 19 bp, Homo sapiens
  mature of SEQ ID 5324
gggataattactatctctc

SEQ ID NO: 7144 - DNA, 22 bp, Homo sapiens
  mature of SEQ ID 5324
gagagggcagtaaatccagctg

SEQ ID NO: 7145 - DNA, 33 bp, Homo sapiens
  mature of SEQ ID 5009
atgatgtcaccgtaatgcattttgggaatagcc

SEQ ID NO: 7146 - DNA, 32 bp, Homo sapiens
  mature of SEQ ID 5009
ttgagttgctttgaatgcaaacctgacatcat

SEQ ID NO: 7147 - DNA, 30 bp, Homo sapiens
  mature of SEQ ID 5009
cacacttgagttgctttgaatgcaaacctg

SEQ ID NO: 7148 - DNA, 18 bp, Homo sapiens
  mature of SEQ ID 4435
tctcttattctttggggg

SEQ ID NO: 7149 - DNA, 21 bp, Homo sapiens
  mature of SEQ ID 4435
gagaatacaaaatataaaggc

SEQ ID NO: 7150 - DNA, 20 bp, Homo sapiens
  mature of SEQ ID 4300
cctgtcaagtgggtgaggtg

SEQ ID NO: 7151 - DNA, 27 bp, Homo sapiens
  mature of SEQ ID 5645
gaaggcaggcaggcacctgtaattata

SEQ ID NO: 7152 - DNA, 29 bp, Homo sapiens
  mature of SEQ ID 5645
attgcagctgaattgcatggtgtgttaag

SEQ ID NO: 7153 - DNA, 31 bp, Homo sapiens
  mature of SEQ ID 5645
cagctgaattgcatggtgtgttaaggctttt

SEQ ID NO: 7154 - DNA, 29 bp, Homo sapiens
  mature of SEQ ID 4318
atatgtttttctttactcaattagtgaat

SEQ ID NO: 7155 - DNA, 24 bp, Homo sapiens
  mature of SEQ ID 4318
aggatttattgatgaatatgatat

SEQ ID NO: 7156 - DNA, 27 bp, Homo sapiens
  mature of SEQ ID 4299
tttccacaatttgcataccattataat

SEQ ID NO: 7157 - DNA, 20 bp, Homo sapiens
  mature of SEQ ID 4264
tatgtatccatttgaggagg

SEQ ID NO: 7158 - DNA, 18 bp, Homo sapiens
  mature of SEQ ID 4264
ttaaaatggttgtctctt

SEQ ID NO: 7159 - DNA, 34 bp, Homo sapiens
  mature of SEQ ID 4883
actcctgttattgtattttaatttgttaagaatt

SEQ ID NO: 7160 - DNA, 21 bp, Homo sapiens
  mature of SEQ ID 4883
gaaagttatagcaagttgata

SEQ ID NO: 7161 - DNA, 30 bp, Homo sapiens
  mature of SEQ ID 4272
ggctctcagttcatcaaatacactgcccta

SEQ ID NO: 7162 - DNA, 23 bp, Homo sapiens
  mature of SEQ ID 4272
tgaatagcctagggctggtatga

SEQ ID NO: 7163 - DNA, 32 bp, Homo sapiens
  mature of SEQ ID 5403
ccccgggatttgtaggggcaccctcccctccc

SEQ ID NO: 7164 - DNA, 33 bp, Homo sapiens
  mature of SEQ ID 4876
tgttgcagctcctggtcggtggtattgttgggt

SEQ ID NO: 7165 - DNA, 32 bp, Homo sapiens
  mature of SEQ ID 4387
gctggcaacaagtcttaggaagtttacgtcat

SEQ ID NO: 7166 - DNA, 31 bp, Homo sapiens
  mature of SEQ ID 4661
gagacagaagaagagtgtttctgaccttttc

SEQ ID NO: 7167 - DNA, 24 bp, Homo sapiens
  mature of SEQ ID 4661
aaaaggaaacacacttcacacatt

SEQ ID NO: 7168 - DNA, 19 bp, Homo sapiens
  mature of SEQ ID 5351
agatcattttgcaaagccc

SEQ ID NO: 7169 - DNA, 31 bp, Homo sapiens
  mature of SEQ ID 5493
atgaaaaactcaacacacaataacagaagtt

SEQ ID NO: 7170 - DNA, 28 bp, Homo sapiens
  mature of SEQ ID 5401
gaatttacagcagataaagatgtagttg

SEQ ID NO: 7171 - DNA, 18 bp, Homo sapiens
  mature of SEQ ID 5713
gaagttgacagatataat

SEQ ID NO: 7172 - DNA, 18 bp, Homo sapiens
  mature of SEQ ID 5713
ttgagatcaggagtctgg

SEQ ID NO: 7173 - DNA, 26 bp, Homo sapiens
  mature of SEQ ID 5335
ttcaatgaccagtatactctcagtgg

SEQ ID NO: 7174 - DNA, 18 bp, Homo sapiens
  mature of SEQ ID 5335
gttgggaaatcagtggaa

SEQ ID NO: 7175 - DNA, 28 bp, Homo sapiens
  mature of SEQ ID 4731
agtgcaggggcagggggccagggtgggg

SEQ ID NO: 7176 - DNA, 18 bp, Homo sapiens
  mature of SEQ ID 4731
ccccagcctggctccctg

SEQ ID NO: 7177 - DNA, 27 bp, Homo sapiens
  mature of SEQ ID 4415
caaattagagtatgaagagattgcctt

SEQ ID NO: 7178 - DNA, 32 bp, Homo sapiens
  mature of SEQ ID 4415
gttatatgtaaggctctttcaacgtaaattaa

SEQ ID NO: 7179 - DNA, 31 bp, Homo sapiens
  mature of SEQ ID 4149
gtttgattatgttggcttggcaggagaaagt

SEQ ID NO: 7180 - DNA, 34 bp, Homo sapiens
  mature of SEQ ID 4149
ttatgttggcttggcaggagaaagtgtttgaaca

SEQ ID NO: 7181 - DNA, 29 bp, Homo sapiens
  mature of SEQ ID 4149
tatttgaaaaacaagccagcagaacaaac

SEQ ID NO: 7182 - DNA, 29 bp, Homo sapiens
  mature of SEQ ID 4111
agttcttattaccatagctttgatttctg

SEQ ID NO: 7183 - DNA, 32 bp, Homo sapiens
  mature of SEQ ID 4111
tagttcaaccggctaaggaattaaattacttg

SEQ ID NO: 7184 - DNA, 19 bp, Homo sapiens
  mature of SEQ ID 5457
ggtcatggctgactgagca

SEQ ID NO: 7185 - DNA, 25 bp, Homo sapiens
  mature of SEQ ID 5398
tgctccttgaggtcagccaggaaat

SEQ ID NO: 7186 - DNA, 21 bp, Homo sapiens
  mature of SEQ ID 5292
gatgatccattttggtccctg

SEQ ID NO: 7187 - DNA, 25 bp, Homo sapiens
  mature of SEQ ID 5292
ggaaaagcgattttccttggtttgg

SEQ ID NO: 7188 - DNA, 34 bp, Homo sapiens
  mature of SEQ ID 4777
attggtgcagatgctccacctgtattaatgtttg

SEQ ID NO: 7189 - DNA, 24 bp, Homo sapiens
  mature of SEQ ID 4854
tttaaagatttagggccagtttac

SEQ ID NO: 7190 - DNA, 28 bp, Homo sapiens
  mature of SEQ ID 4854
ggatgtttctgtctttgagtttgaatga

SEQ ID NO: 7191 - DNA, 22 bp, Homo sapiens
  mature of SEQ ID 5470
gtgtaagctgcggcccttgctg

SEQ ID NO: 7192 - DNA, 19 bp, Homo sapiens
  mature of SEQ ID 5470
accatctgccgctttgagg

SEQ ID NO: 7193 - DNA, 28 bp, Homo sapiens
  mature of SEQ ID 4486
tcaaagatctgaaaggctttctctgtat

SEQ ID NO: 7194 - DNA, 20 bp, Homo sapiens
  mature of SEQ ID 4081
atgctttgttttataatttg

SEQ ID NO: 7195 - DNA, 18 bp, Homo sapiens
  mature of SEQ ID 4081
gcaaattgttagaatcag

SEQ ID NO: 7196 - DNA, 26 bp, Homo sapiens
  mature of SEQ ID 4642
aaactgaactgaaagctttagctgaa

SEQ ID NO: 7197 - DNA, 20 bp, Homo sapiens
  mature of SEQ ID 5155
ggaaatgtgctgctgattat

SEQ ID NO: 7198 - DNA, 24 bp, Homo sapiens
  mature of SEQ ID 5155
aaatgacaactattaatttagtgg

SEQ ID NO: 7199 - DNA, 31 bp, Homo sapiens
  mature of SEQ ID 4365
tttgtaaacacatttcaaaaaatataaatgc

SEQ ID NO: 7200 - DNA, 31 bp, Homo sapiens
  mature of SEQ ID 5214
catcgagaggaaaattagcatttattttccc

SEQ ID NO: 7201 - DNA, 18 bp, Homo sapiens
  mature of SEQ ID 4209
ggtagaagataactgaaa

SEQ ID NO: 7202 - DNA, 30 bp, Homo sapiens
  mature of SEQ ID 4393
actaatcatattaatgttatacttgttttg

SEQ ID NO: 7203 - DNA, 27 bp, Homo sapiens
  mature of SEQ ID 4393
ggtctaattttcattaagcatgactac

SEQ ID NO: 7204 - DNA, 19 bp, Homo sapiens
  mature of SEQ ID 4478
agatattgacaaaggaatt

SEQ ID NO: 7205 - DNA, 30 bp, Homo sapiens
  mature of SEQ ID 4478
agtactttaagtcaatattactttagtgga

SEQ ID NO: 7206 - DNA, 27 bp, Homo sapiens
  mature of SEQ ID 4847
atcatgtcatttctaataagatgacac

SEQ ID NO: 7207 - DNA, 24 bp, Homo sapiens
  mature of SEQ ID 4847
tcagttgtattgaagaaacatgat

SEQ ID NO: 7208 - DNA, 24 bp, Homo sapiens
  mature of SEQ ID 4971
ggaaagcaatctagttccaattct

SEQ ID NO: 7209 - DNA, 20 bp, Homo sapiens
  mature of SEQ ID 4632
tttggtgacattatcaacta

SEQ ID NO: 7210 - DNA, 28 bp, Homo sapiens
  mature of SEQ ID 4632
ttaaggtgagaaatgtgatagaaagagc

SEQ ID NO: 7211 - DNA, 29 bp, Homo sapiens
  mature of SEQ ID 5102
ttagcagcattactaatgtgcctttgggg

SEQ ID NO: 7212 - DNA, 32 bp, Homo sapiens
  mature of SEQ ID 5102
ctctaaagtacacattattaaagtctattaaa

SEQ ID NO: 7213 - DNA, 34 bp, Homo sapiens
  mature of SEQ ID 4654
agactcattttgaatttgaacttaacaaccagaa

SEQ ID NO: 7214 - DNA, 31 bp, Homo sapiens
  mature of SEQ ID 4654
aatgccagactcattttgaatttgaacttaa

SEQ ID NO: 7215 - DNA, 20 bp, Homo sapiens
  mature of SEQ ID 5067
caagaaatgtgaggtaaggc

SEQ ID NO: 7216 - DNA, 30 bp, Homo sapiens
  mature of SEQ ID 5067
tcctttctctaatttcttgtgacacacggt

SEQ ID NO: 7217 - DNA, 31 bp, Homo sapiens
  mature of SEQ ID 4043
tggtcagctctccctggggtccagcagcttt

SEQ ID NO: 7218 - DNA, 31 bp, Homo sapiens
  mature of SEQ ID 5120
gcagatggcaagatccgaatttacaatttcc

SEQ ID NO: 7219 - DNA, 31 bp, Homo sapiens
  mature of SEQ ID 5165
tcaatgtccaccttgggtcctgagatgtcaa

SEQ ID NO: 7220 - DNA, 33 bp, Homo sapiens
  mature of SEQ ID 5165
tccaccttgggtcctgagatgtcaacgtcagcc

SEQ ID NO: 7221 - DNA, 31 bp, Homo sapiens
  mature of SEQ ID 4208
tctgctttacaccagccgagtttaaggtgtc

SEQ ID NO: 7222 - DNA, 29 bp, Homo sapiens
  mature of SEQ ID 4208
gagctctgctttacaccagccgagtttaa

SEQ ID NO: 7223 - DNA, 26 bp, Homo sapiens
  mature of SEQ ID 4555
ttcctcaccctttgtccttcccaaca

SEQ ID NO: 7224 - DNA, 19 bp, Homo sapiens
  mature of SEQ ID 4555
tggaatgtgtcaggaagag

SEQ ID NO: 7225 - DNA, 28 bp, Homo sapiens
  mature of SEQ ID 4375
ggaatgtcaccccagtgacacttttgtg

SEQ ID NO: 7226 - DNA, 18 bp, Homo sapiens
  mature of SEQ ID 5598
tggcaattttatattcct

SEQ ID NO: 7227 - DNA, 28 bp, Homo sapiens
  mature of SEQ ID 5598
tgtctgttcagattccaagggagtttag

SEQ ID NO: 7228 - DNA, 22 bp, Homo sapiens
  mature of SEQ ID 4187
aggctgtacagagtcccggaac

SEQ ID NO: 7229 - DNA, 22 bp, Homo sapiens
  mature of SEQ ID 5536
attcagacagggttgcctttct

SEQ ID NO: 7230 - DNA, 18 bp, Homo sapiens
  mature of SEQ ID 4937
ctctcgtggatctgagcc

SEQ ID NO: 7231 - DNA, 31 bp, Homo sapiens
  mature of SEQ ID 4937
gctcaggctcctcgctggccaggtccaaggg

SEQ ID NO: 7232 - DNA, 29 bp, Homo sapiens
  mature of SEQ ID 4179
gctcaaagggcatgcatttttgtttatga

SEQ ID NO: 7233 - DNA, 31 bp, Homo sapiens
  mature of SEQ ID 4570
ccactggcttattagtttcacagatgcttcc

SEQ ID NO: 7234 - DNA, 17 bp, Homo sapiens
  mature of SEQ ID 5119
tcactgccatgatagct

SEQ ID NO: 7235 - DNA, 23 bp, Homo sapiens
  mature of SEQ ID 5119
cagtctgtctactgtggtgatct

SEQ ID NO: 7236 - DNA, 22 bp, Homo sapiens
  mature of SEQ ID 4822
attatattattttcttgttgag

SEQ ID NO: 7237 - DNA, 25 bp, Homo sapiens
  mature of SEQ ID 4674
aaaaatacaaaagttaagattttta

SEQ ID NO: 7238 - DNA, 29 bp, Homo sapiens
  mature of SEQ ID 5154
ggcaccccggacagggcgctcccaaggag

SEQ ID NO: 7239 - DNA, 24 bp, Homo sapiens
  mature of SEQ ID 5430
gtcgcctgcaggaagtgttggcgc

SEQ ID NO: 7240 - DNA, 26 bp, Homo sapiens
  mature of SEQ ID 5430
gcgcgcatccgctatctgcaggcggc

SEQ ID NO: 7241 - DNA, 18 bp, Homo sapiens
  mature of SEQ ID 5616
tatttttatttctgagta

SEQ ID NO: 7242 - DNA, 22 bp, Homo sapiens
  mature of SEQ ID 5695
gctgtctggggaactcagaagg

SEQ ID NO: 7243 - DNA, 20 bp, Homo sapiens
  mature of SEQ ID 5695
aagttttggctcttcagggc

SEQ ID NO: 7244 - DNA, 25 bp, Homo sapiens
  mature of SEQ ID 5227
tctcatgaatatgaatttgcatttg

SEQ ID NO: 7245 - DNA, 20 bp, Homo sapiens
  mature of SEQ ID 4125
ttagttcatcttttgtgaaa

SEQ ID NO: 7246 - DNA, 19 bp, Homo sapiens
  mature of SEQ ID 4125
tcaggctaatacagaagtg

SEQ ID NO: 7247 - DNA, 34 bp, Homo sapiens
  mature of SEQ ID 4730
gattagggtcattatgttggaggtctgatttatg

SEQ ID NO: 7248 - DNA, 31 bp, Homo sapiens
  mature of SEQ ID 4730
ccaactgattagggtcattatgttggaggtc

SEQ ID NO: 7249 - DNA, 36 bp, Homo sapiens
  mature of SEQ ID 4730
tcaccgatcctgcatcaatgaatcttaatgaattgg

SEQ ID NO: 7250 - DNA, 34 bp, Homo sapiens
  mature of SEQ ID 4730
catttcctctcaccgatcctgcatcaatgaatct

SEQ ID NO: 7251 - DNA, 33 bp, Homo sapiens
  mature of SEQ ID 4702
gctctgcggctgcgaaaacccggagaggcggat

SEQ ID NO: 7252 - DNA, 32 bp, Homo sapiens
  mature of SEQ ID 4702
cagccaactcctccgcggtccggccgccgagc

SEQ ID NO: 7253 - DNA, 20 bp, Homo sapiens
  mature of SEQ ID 5739
gtgtatttaaatatatttag

SEQ ID NO: 7254 - DNA, 22 bp, Homo sapiens
  mature of SEQ ID 5739
catgtttacttgcacattccta

SEQ ID NO: 7255 - DNA, 30 bp, Homo sapiens
  mature of SEQ ID 5739
taggcctgaataactggctgatagatacat

SEQ ID NO: 7256 - DNA, 23 bp, Homo sapiens
  mature of SEQ ID 4748
agctttgaaatgctacactttct

SEQ ID NO: 7257 - DNA, 21 bp, Homo sapiens
  mature of SEQ ID 4748
ctgaaatgtaaaatattctgc

SEQ ID NO: 7258 - DNA, 19 bp, Homo sapiens
  mature of SEQ ID 4164
acatactgtgtcctcagat

SEQ ID NO: 7259 - DNA, 28 bp, Homo sapiens
  mature of SEQ ID 4164
tctgtcagcatttgtgaggacaaaccac

SEQ ID NO: 7260 - DNA, 27 bp, Homo sapiens
  mature of SEQ ID 4315
tttaccttaggaagggagggagttctc

SEQ ID NO: 7261 - DNA, 19 bp, Homo sapiens
  mature of SEQ ID 5677
cttctgtaaacagagtgtc

SEQ ID NO: 7262 - DNA, 28 bp, Homo sapiens
  mature of SEQ ID 5677
tggtgatgagcagcccagctggatcccc

SEQ ID NO: 7263 - DNA, 17 bp, Homo sapiens
  mature of SEQ ID 5027
gcatggagagtccctga

SEQ ID NO: 7264 - DNA, 23 bp, Homo sapiens
  mature of SEQ ID 5027
tcaggagagtccgtggcttttgg

SEQ ID NO: 7265 - DNA, 21 bp, Homo sapiens
  mature of SEQ ID 5362
acggtctgagtgtaccctaaa

SEQ ID NO: 7266 - DNA, 20 bp, Homo sapiens
  mature of SEQ ID 5261
agggttgtaactggatggtg

SEQ ID NO: 7267 - DNA, 22 bp, Homo sapiens
  mature of SEQ ID 5261
ttcactaagattgttttaccat

SEQ ID NO: 7268 - DNA, 21 bp, Homo sapiens
  mature of SEQ ID 5530
caggccaggaaggctagggac

SEQ ID NO: 7269 - DNA, 29 bp, Homo sapiens
  mature of SEQ ID 5530
agacaccctgtctagaatggcccttggtc

SEQ ID NO: 7270 - DNA, 32 bp, Homo sapiens
  mature of SEQ ID 5530
accctgtctagaatggcccttggtcctggagg

SEQ ID NO: 7271 - DNA, 32 bp, Homo sapiens; identical to SEQ ID NO: 5981
  mature of SEQ ID 5611

SEQ ID NO: 7272 - DNA, 33 bp, Homo sapiens; identical to SEQ ID NO: 5980
  mature of SEQ ID 5611

SEQ ID NO: 7273 - DNA, 17 bp, Homo sapiens
  mature of SEQ ID 4943
tattttcttaaacagtt

SEQ ID NO: 7274 - DNA, 31 bp, Homo sapiens
  mature of SEQ ID 4943
aaatggcagaattaaatgtagtttggtgaaa

SEQ ID NO: 7275 - DNA, 31 bp, Homo sapiens
  mature of SEQ ID 4158
cagaagaaaagaacaggtgcagggggagtgt

SEQ ID NO: 7276 - DNA, 24 bp, Homo sapiens
  mature of SEQ ID 4158
ctgagaattctcctcctcgtactt

SEQ ID NO: 7277 - DNA, 23 bp, Homo sapiens
  mature of SEQ ID 4456
cttctagcttcaatcacattgtt

SEQ ID NO: 7278 - DNA, 34 bp, Homo sapiens
  mature of SEQ ID 4852
cggaaaggcgctctcctttccactttttggccct

SEQ ID NO: 7279 - DNA, 28 bp, Homo sapiens
  mature of SEQ ID 4852
gggctggggagggagagttggcgagctg

SEQ ID NO: 7280 - DNA, 24 bp, Homo sapiens
  mature of SEQ ID 4582
ctgttcaaatacaaagtatattca

SEQ ID NO: 7281 - DNA, 20 bp, Homo sapiens
  mature of SEQ ID 4720
gctaaggatttcaacctaga

SEQ ID NO: 7282 - DNA, 18 bp, Homo sapiens
  mature of SEQ ID 4720
tattgatcacaattagat

SEQ ID NO: 7283 - DNA, 17 bp, Homo sapiens
  mature of SEQ ID 4210
atgagttaggagttaac

SEQ ID NO: 7284 - DNA, 29 bp, Homo sapiens
  mature of SEQ ID 4860
gtcttcatgtcactgatgagttcaaagcc

SEQ ID NO: 7285 - DNA, 27 bp, Homo sapiens
  mature of SEQ ID 4442
attattgactaaatggtgctctggttc

SEQ ID NO: 7286 - DNA, 30 bp, Homo sapiens
  mature of SEQ ID 4442
tggaggccaccagggcaccattagcacata

SEQ ID NO: 7287 - DNA, 18 bp, Homo sapiens
  mature of SEQ ID 5519
gtggccagtgaattggca

SEQ ID NO: 7288 - DNA, 23 bp, Homo sapiens
  mature of SEQ ID 4160
tacctcaaagacaggctggggct

SEQ ID NO: 7289 - DNA, 30 bp, Homo sapiens
  mature of SEQ ID 5355
cctccgtcctgcctggtgctgggatcagct

SEQ ID NO: 7290 - DNA, 17 bp, Homo sapiens
  mature of SEQ ID 5355
ccagggtgggcgtttgg

SEQ ID NO: 7291 - DNA, 22 bp, Homo sapiens
  mature of SEQ ID 4522
gggtaattagtttcagaccctg

SEQ ID NO: 7292 - DNA, 30 bp, Homo sapiens
  mature of SEQ ID 4476
atagctctcaggtcagtgcatcctcaaagc

SEQ ID NO: 7293 - DNA, 25 bp, Homo sapiens
  mature of SEQ ID 4039
aactgctgtagtgataattaggtta

SEQ ID NO: 7294 - DNA, 34 bp, Homo sapiens
  mature of SEQ ID 4039
ttttcaacctacatgtcactttaatagcttggtt

SEQ ID NO: 7295 - DNA, 32 bp, Homo sapiens
  mature of SEQ ID 4039
taatgtattttcaacctacatgtcactttaat

SEQ ID NO: 7296 - DNA, 31 bp, Homo sapiens
  mature of SEQ ID 4546
atgctctaggacatgtacttggaaatgcaaa

SEQ ID NO: 7297 - DNA, 33 bp, Homo sapiens
  mature of SEQ ID 4546
taggacatgtacttggaaatgcaaaacaaataa

SEQ ID NO: 7298 - DNA, 24 bp, Homo sapiens
  mature of SEQ ID 4546
ctttccccaacacatctccccaag

SEQ ID NO: 7299 - DNA, 29 bp, Homo sapiens
  mature of SEQ ID 4241
gctatggttttcattaaatttaattaagt

SEQ ID NO: 7300 - DNA, 22 bp, Homo sapiens
  mature of SEQ ID 4241
acttaatttcctcaggaataac

SEQ ID NO: 7301 - DNA, 18 bp, Homo sapiens
  mature of SEQ ID 4747
atgccagcggaaatgcaa

SEQ ID NO: 7302 - DNA, 34 bp, Homo sapiens
  mature of SEQ ID 4747
acttatgaactggcaaagaataaatggctgccat

SEQ ID NO: 7303 - DNA, 32 bp, Homo sapiens
  mature of SEQ ID 4747
aggaagcacttatgaactggcaaagaataaat

SEQ ID NO: 7304 - DNA, 24 bp, Homo sapiens
  mature of SEQ ID 4544
gcggctgcgggcgcgcggccggct

SEQ ID NO: 7305 - DNA, 23 bp, Homo sapiens
  mature of SEQ ID 5620
tgccaaacatctggatgaaaagt

SEQ ID NO: 7306 - DNA, 30 bp, Homo sapiens
  mature of SEQ ID 4530
tctttaagaaagaaccatggtgtgttgtga

SEQ ID NO: 7307 - DNA, 18 bp, Homo sapiens
  mature of SEQ ID 4710
ggggcagggagggaaggc

SEQ ID NO: 7308 - DNA, 23 bp, Homo sapiens
  mature of SEQ ID 4710
tgtgtggatcctggtattttcct

SEQ ID NO: 7309 - DNA, 27 bp, Homo sapiens
  mature of SEQ ID 4917
tgttagtgattttcatattacattagc

SEQ ID NO: 7310 - DNA, 24 bp, Homo sapiens
  mature of SEQ ID 4121
ttccattttattttatgaaacatt

SEQ ID NO: 7311 - DNA, 24 bp, Homo sapiens
  mature of SEQ ID 4545
agggggaattcccttgaatatggt

SEQ ID NO: 7312 - DNA, 25 bp, Homo sapiens
  mature of SEQ ID 4954
atttttgcatcttatccagcatcaa

SEQ ID NO: 7313 - DNA, 28 bp, Homo sapiens
  mature of SEQ ID 4789
tgtgatttggggcaagagaaaagccata

SEQ ID NO: 7314 - DNA, 26 bp, Homo sapiens
  mature of SEQ ID 4976
ggatcctctaccgctgccttgatttt

SEQ ID NO: 7315 - DNA, 25 bp, Homo sapiens
  mature of SEQ ID 5632
taaaagataaaacagggacaaaaac

SEQ ID NO: 7316 - DNA, 29 bp, Homo sapiens
  mature of SEQ ID 4124
ggactgcaggaagctctgtcaccccatgt

SEQ ID NO: 7317 - DNA, 32 bp, Homo sapiens
  mature of SEQ ID 4124
aagttttggcagaggttctatgtttgtaaacc

SEQ ID NO: 7318 - DNA, 17 bp, Homo sapiens
  mature of SEQ ID 5332
ttaaaatcatatggctg

SEQ ID NO: 7319 - DNA, 18 bp, Homo sapiens
  mature of SEQ ID 5332
gtcataataggaagaata

SEQ ID NO: 7320 - DNA, 32 bp, Homo sapiens
  mature of SEQ ID 5332
tgttcttcccactctggaagtcttgattttaa

SEQ ID NO: 7321 - DNA, 34 bp, Homo sapiens
  mature of SEQ ID 5393
ttatagaaagtgcagttctcagcttcagacactg

SEQ ID NO: 7322 - DNA, 22 bp, Homo sapiens
  mature of SEQ ID 5393
cagtgaagatgctgagctgtcc

SEQ ID NO: 7323 - DNA, 30 bp, Homo sapiens
  mature of SEQ ID 5354
tatacaatttagtttgattacagtataggt

SEQ ID NO: 7324 - DNA, 31 bp, Homo sapiens
  mature of SEQ ID 4704
ctcagggcagcaaagagaacatagagattca

SEQ ID NO: 7325 - DNA, 33 bp, Homo sapiens
  mature of SEQ ID 4704
tgagctttctttgtagggcactgtctgctttga

SEQ ID NO: 7326 - DNA, 31 bp, Homo sapiens
  mature of SEQ ID 5316
gacatttttgactgaattgaccaggtgctag

SEQ ID NO: 7327 - DNA, 17 bp, Homo sapiens
  mature of SEQ ID 5316
ctaacacctgtcaattc

SEQ ID NO: 7328 - DNA, 33 bp, Homo sapiens
  mature of SEQ ID 5523
atttgcagctgaatatacttctatattttaact

SEQ ID NO: 7329 - DNA, 26 bp, Homo sapiens
  mature of SEQ ID 5523
ttgacttattttagaagtgttccttc

SEQ ID NO: 7330 - DNA, 26 bp, Homo sapiens
  mature of SEQ ID 5444
ctatgtattctccttctattaagtta

SEQ ID NO: 7331 - DNA, 34 bp, Homo sapiens
  mature of SEQ ID 5444
aggtgatttattaagatgagaagcagacattgct

SEQ ID NO: 7332 - DNA, 25 bp, Homo sapiens
  mature of SEQ ID 4875
tttggaatgtcagattaggactgtt

SEQ ID NO: 7333 - DNA, 29 bp, Homo sapiens
  mature of SEQ ID 4875
agtgggtaatagccttgttttcccaagag

SEQ ID NO: 7334 - DNA, 17 bp, Homo sapiens
  mature of SEQ ID 4448
ctgcagtacaatgaagc

SEQ ID NO: 7335 - DNA, 23 bp, Homo sapiens
  mature of SEQ ID 4448
ctagattgggtcatgctcactgg

SEQ ID NO: 7336 - DNA, 26 bp, Homo sapiens
  mature of SEQ ID 5531
agaaggctagtgctgtgggcatttca

SEQ ID NO: 7337 - DNA, 34 bp, Homo sapiens
  mature of SEQ ID 5531
ttctaagtacttgcccataaaaaattatgtggct

SEQ ID NO: 7338 - DNA, 18 bp, Homo sapiens
  mature of SEQ ID 4708
tgaggcagcacagaaggc

SEQ ID NO: 7339 - DNA, 25 bp, Homo sapiens
  mature of SEQ ID 4118
gttactagaaggcggggttgatcca

SEQ ID NO: 7340 - DNA, 31 bp, Homo sapiens
  mature of SEQ ID 4118
gctacagcaatgcaccgggcagcagccaagg

SEQ ID NO: 7341 - DNA, 34 bp, Homo sapiens
  mature of SEQ ID 4118
gcaatgcaccgggcagcagccaagggtaacttga

SEQ ID NO: 7342 - DNA, 25 bp, Homo sapiens
  mature of SEQ ID 5186
tgaacgtccacatctgggacatcaa

SEQ ID NO: 7343 - DNA, 27 bp, Homo sapiens
  mature of SEQ ID 5186
ttggggtccctgatgtcaacttcgggg

SEQ ID NO: 7344 - DNA, 17 bp, Homo sapiens
  mature of SEQ ID 4787
gtaaattttcatgtaat

SEQ ID NO: 7345 - DNA, 27 bp, Homo sapiens
  mature of SEQ ID 4787
tgaaaactagaccacacaggagaaata

SEQ ID NO: 7346 - DNA, 18 bp, Homo sapiens
  mature of SEQ ID 4222
acagatgaagaagttgat

SEQ ID NO: 7347 - DNA, 18 bp, Homo sapiens
  mature of SEQ ID 4222
gatggtcaagtaaactat

SEQ ID NO: 7348 - DNA, 26 bp, Homo sapiens
  mature of SEQ ID 5274
gaagtgctgggctgcgtgctagcggg

SEQ ID NO: 7349 - DNA, 26 bp, Homo sapiens
  mature of SEQ ID 4910
gcatacaatgggctatacttatggaa

SEQ ID NO: 7350 - DNA, 20 bp, Homo sapiens
  mature of SEQ ID 4910
ctgagatccaaagtagagaa

SEQ ID NO: 7351 - DNA, 33 bp, Homo sapiens
  mature of SEQ ID 4599
atagtaccgtattggtgtataggtctttgcgga

SEQ ID NO: 7352 - DNA, 31 bp, Homo sapiens
  mature of SEQ ID 4599
caccggatagtaccgtattggtgtataggtc

SEQ ID NO: 7353 - DNA, 31 bp, Homo sapiens
  mature of SEQ ID 4599
catcctgtcagcaatgcctggatacatggtg

SEQ ID NO: 7354 - DNA, 29 bp, Homo sapiens
  mature of SEQ ID 4599
tctgcatcctgtcagcaatgcctggatac

SEQ ID NO: 7355 - DNA, 26 bp, Homo sapiens
  mature of SEQ ID 5183
attgctcattcctcttcaactgcttt

SEQ ID NO: 7356 - DNA, 20 bp, Homo sapiens
  mature of SEQ ID 5183
agaggagaaaatgaccctgt

SEQ ID NO: 7357 - DNA, 32 bp, Homo sapiens
  mature of SEQ ID 5151
ttgatctggtgacttctcaggaagtagcatct

SEQ ID NO: 7358 - DNA, 29 bp, Homo sapiens
  mature of SEQ ID 5151
tgttttgatctggtgacttctcaggaagt

SEQ ID NO: 7359 - DNA, 23 bp, Homo sapiens
  mature of SEQ ID 5151
gcttttcctgttgggagtaaaga

SEQ ID NO: 7360 - DNA, 18 bp, Homo sapiens
  mature of SEQ ID 4780
atgccaatgaccctcatg

SEQ ID NO: 7361 - DNA, 26 bp, Homo sapiens
  mature of SEQ ID 4780
gcctgtgcatcagggtaatttggcat

SEQ ID NO: 7362 - DNA, 21 bp, Homo sapiens
  mature of SEQ ID 4389
aaaatttgcattcctataaat

SEQ ID NO: 7363 - DNA, 18 bp, Homo sapiens
  mature of SEQ ID 4389
ttaaatgacaagcctttt

SEQ ID NO: 7364 - DNA, 28 bp, Homo sapiens
  mature of SEQ ID 4186
caatgaaataatcagttgtcatggtaac

SEQ ID NO: 7365 - DNA, 30 bp, Homo sapiens
  mature of SEQ ID 4186
agattttgtcaccatggcaactggtcattg

SEQ ID NO: 7366 - DNA, 27 bp, Homo sapiens
  mature of SEQ ID 5672
ctcaaagtgtgtctgctcggggtgagt

SEQ ID NO: 7367 - DNA, 34 bp, Homo sapiens
  mature of SEQ ID 5672
cccgcgcccctggctcccgggccatggcgctgag

SEQ ID NO: 7368 - DNA, 24 bp, Homo sapiens
  mature of SEQ ID 5681
tccgaattgtttctgggtaatttg

SEQ ID NO: 7369 - DNA, 33 bp, Homo sapiens
  mature of SEQ ID 5681
aaattacctacactgttcacaaaccagcaggca

SEQ ID NO: 7370 - DNA, 30 bp, Homo sapiens
  mature of SEQ ID 5681
gtggcaaattacctacactgttcacaaacc

SEQ ID NO: 7371 - DNA, 34 bp, Homo sapiens
  mature of SEQ ID 4909
ttcctcagccactgggtttttctgtgtgtggttt

SEQ ID NO: 7372 - DNA, 27 bp, Homo sapiens
  mature of SEQ ID 4430
gcctgcatttcagttcttgtttctttg

SEQ ID NO: 7373 - DNA, 33 bp, Homo sapiens
  mature of SEQ ID 5287
aagccccagagcatggcccacttcatgggctgc

SEQ ID NO: 7374 - DNA, 31 bp, Homo sapiens
  mature of SEQ ID 5287
gtgcccaagccccagagcatggcccacttca

SEQ ID NO: 7375 - DNA, 18 bp, Homo sapiens
  mature of SEQ ID 4782
gacgtccagcagctgcgc

SEQ ID NO: 7376 - DNA, 23 bp, Homo sapiens
  mature of SEQ ID 4782
gccaggccctcacgcagctcact

SEQ ID NO: 7377 - DNA, 17 bp, Homo sapiens
  mature of SEQ ID 5518
ggttgcttagaatgccc

SEQ ID NO: 7378 - DNA, 34 bp, Homo sapiens
  mature of SEQ ID 5518
gctaaaattcttaacaacacttgaaagaatattt

SEQ ID NO: 7379 - DNA, 31 bp, Homo sapiens
  mature of SEQ ID 5290
gatggagtctagctcttggtgactagcatta

SEQ ID NO: 7380 - DNA, 28 bp, Homo sapiens
  mature of SEQ ID 5290
ctagtgctacatagggctcatttttatt

SEQ ID NO: 7381 - DNA, 28 bp, Homo sapiens
  mature of SEQ ID 4507
agctgaaatttagaattattgtttcctt

SEQ ID NO: 7382 - DNA, 27 bp, Homo sapiens
  mature of SEQ ID 5068
tgcaaagataaaagcaggtttctgaag

SEQ ID NO: 7383 - DNA, 17 bp, Homo sapiens
  mature of SEQ ID 5046
gtggggcggctggcagc

SEQ ID NO: 7384 - DNA, 22 bp, Homo sapiens
  mature of SEQ ID 5046
gggctagctggctctctggagg

SEQ ID NO: 7385 - DNA, 25 bp, Homo sapiens
  mature of SEQ ID 5182
ctttctctgtgtctgtctctcccac

SEQ ID NO: 7386 - DNA, 20 bp, Homo sapiens
  mature of SEQ ID 5182
gtgggatgatgtcacagaca

SEQ ID NO: 7387 - DNA, 34 bp, Homo sapiens
  mature of SEQ ID 4973
gctcaacttgccagctgaagggaagctcctggct

SEQ ID NO: 7388 - DNA, 29 bp, Homo sapiens
  mature of SEQ ID 4973
ggagcttctggtcagcctggccaataagc

SEQ ID NO: 7389 - DNA, 18 bp, Homo sapiens
  mature of SEQ ID 5629
gtctcaccttggcgctcc

SEQ ID NO: 7390 - DNA, 18 bp, Homo sapiens
  mature of SEQ ID 5629
ggctcggattacgcaagg

SEQ ID NO: 7391 - DNA, 27 bp, Homo sapiens
  mature of SEQ ID 5494
cattcagatcttgctatccacacaaac

SEQ ID NO: 7392 - DNA, 34 bp, Homo sapiens
  mature of SEQ ID 5494
tttcatctgtgtctggtagcagtgtctgtctgtg

SEQ ID NO: 7393 - DNA, 34 bp, Homo sapiens
  mature of SEQ ID 5392
aggggagatatttgctattttctccactgatttg

SEQ ID NO: 7394 - DNA, 21 bp, Homo sapiens
  mature of SEQ ID 5392
taggtcagattgagagctgaa

SEQ ID NO: 7395 - DNA, 20 bp, Homo sapiens
  mature of SEQ ID 4577
gctcatctgagctgccaaga

SEQ ID NO: 7396 - DNA, 18 bp, Homo sapiens
  mature of SEQ ID 4577
tcttggcaatgtttaatg

SEQ ID NO: 7397 - DNA, 17 bp, Homo sapiens
  mature of SEQ ID 5342
gtaagtcatgtgaaagg

SEQ ID NO: 7398 - DNA, 20 bp, Homo sapiens
  mature of SEQ ID 5342
tatgataacatttcctgaga

SEQ ID NO: 7399 - DNA, 29 bp, Homo sapiens
  mature of SEQ ID 5625
agggtctcctcgcctgacctttgtctctc

SEQ ID NO: 7400 - DNA, 20 bp, Homo sapiens
  mature of SEQ ID 5623
cctttttaaatgtgctgaat

SEQ ID NO: 7401 - DNA, 27 bp, Homo sapiens
  mature of SEQ ID 5623
gagagcttacctctgatcagcttggag

SEQ ID NO: 7402 - DNA, 20 bp, Homo sapiens
  mature of SEQ ID 5627
aaaagcaaatagcagactct

SEQ ID NO: 7403 - DNA, 22 bp, Homo sapiens
  mature of SEQ ID 4462
ttatacttaaaggcaattaaac

SEQ ID NO: 7404 - DNA, 32 bp, Homo sapiens; identical to SEQ ID NO: 6316
  mature of SEQ ID 5083

SEQ ID NO: 7405 - DNA, 24 bp, Homo sapiens
  mature of SEQ ID 4686
agacacaatggaaggcaggctggc

SEQ ID NO: 7406 - DNA, 30 bp, Homo sapiens
  mature of SEQ ID 4686
ctgtttaaacagcactatccattgtagttt

SEQ ID NO: 7407 - DNA, 29 bp, Homo sapiens
  mature of SEQ ID 5207
cacaggaactatttgctaatgctggttac

SEQ ID NO: 7408 - DNA, 32 bp, Homo sapiens
  mature of SEQ ID 5207
ggaactatttgctaatgctggttaccatttga

SEQ ID NO: 7409 - DNA, 26 bp, Homo sapiens
  mature of SEQ ID 4696
taggccccatctttctagggacgtgg

SEQ ID NO: 7410 - DNA, 25 bp, Homo sapiens
  mature of SEQ ID 4696
acatgaccctatctatgtatttata

SEQ ID NO: 7411 - DNA, 25 bp, Homo sapiens
  mature of SEQ ID 4540
agaactttcactttttggctgtgcc

SEQ ID NO: 7412 - DNA, 21 bp, Homo sapiens
  mature of SEQ ID 5193
tgttgttaatttgaaggccag

SEQ ID NO: 7413 - DNA, 17 bp, Homo sapiens
  mature of SEQ ID 4231
catcaatatgtatatat

SEQ ID NO: 7414 - DNA, 31 bp, Homo sapiens
  mature of SEQ ID 4231
tttgtgaagagggacataagataaaatgatg

SEQ ID NO: 7415 - DNA, 31 bp, Homo sapiens
  mature of SEQ ID 4598
atcatcaaagagcatcccttggttagtgtgg

SEQ ID NO: 7416 - DNA, 29 bp, Homo sapiens
  mature of SEQ ID 4598
ccatgatcacagtaatgttctttggagat

SEQ ID NO: 7417 - DNA, 33 bp, Homo sapiens
  mature of SEQ ID 4751
ggaggtgatagaaaatgccagttactgtggtat

SEQ ID NO: 7418 - DNA, 35 bp, Homo sapiens
  mature of SEQ ID 4751
tagaaaatgccagttactgtggtatttaactgaca

SEQ ID NO: 7419 - DNA, 32 bp, Homo sapiens
  mature of SEQ ID 5412
tgctgatggcaccatctgctttctgcaattct

SEQ ID NO: 7420 - DNA, 26 bp, Homo sapiens
  mature of SEQ ID 5412
gcacagaagtaaccgcagatgccaca

SEQ ID NO: 7421 - DNA, 19 bp, Homo sapiens
  mature of SEQ ID 4184
gtgcttcagccatttttca

SEQ ID NO: 7422 - DNA, 20 bp, Homo sapiens
  mature of SEQ ID 5441
tgatgttctcacccttgttg

SEQ ID NO: 7423 - DNA, 31 bp, Homo sapiens
  mature of SEQ ID 5441
tgaaacaaaatcaatcctaggggagaatgca

SEQ ID NO: 7424 - DNA, 34 bp, Homo sapiens
  mature of SEQ ID 4614
tcctagaaaaggaagattaaattactgggatatg

SEQ ID NO: 7425 - DNA, 31 bp, Homo sapiens
  mature of SEQ ID 4614
ctggagtcctagaaaaggaagattaaattac

SEQ ID NO: 7426 - DNA, 19 bp, Homo sapiens
  mature of SEQ ID 4614
tatatttcagttatgcaag

SEQ ID NO: 7427 - DNA, 17 bp, Homo sapiens
  mature of SEQ ID 4614
tcttttctttgccaaag

SEQ ID NO: 7428 - DNA, 32 bp, Homo sapiens
  mature of SEQ ID 4714
tatctataaaaatttgtttctagatggcaatt

SEQ ID NO: 7429 - DNA, 25 bp, Homo sapiens
  mature of SEQ ID 4575
ccaccccgtggctaatccgtccccc

SEQ ID NO: 7430 - DNA, 17 bp, Homo sapiens
  mature of SEQ ID 4575
gggggacccagggagcc

SEQ ID NO: 7431 - DNA, 22 bp, Homo sapiens
  mature of SEQ ID 5466
aaggcaactgctgatttacaag

SEQ ID NO: 7432 - DNA, 23 bp, Homo sapiens
  mature of SEQ ID 5466
tttgttgttgatttaggctggag

SEQ ID NO: 7433 - DNA, 19 bp, Homo sapiens
  mature of SEQ ID 4620
aaaacaggtggtactccag

SEQ ID NO: 7434 - DNA, 19 bp, Homo sapiens
  mature of SEQ ID 4620
gatctgttggattctctac

SEQ ID NO: 7435 - DNA, 34 bp, Homo sapiens
  mature of SEQ ID 5646
gtgcatatcacgcccccgtgctggtagtggatgg

SEQ ID NO: 7436 - DNA, 20 bp, Homo sapiens
  mature of SEQ ID 4223
cctgacagggatgaaaggaa

SEQ ID NO: 7437 - DNA, 33 bp, Homo sapiens
  mature of SEQ ID 4223
tgtgtgtccacaaacttgcctggaatctatcag

SEQ ID NO: 7438 - DNA, 27 bp, Homo sapiens
  mature of SEQ ID 5359
ttcattgcttattatgttaatattatg

SEQ ID NO: 7439 - DNA, 24 bp, Homo sapiens
  mature of SEQ ID 5359
gcataactgttagcaaacaatgga

SEQ ID NO: 7440 - DNA, 33 bp, Homo sapiens; identical to SEQ ID NO: 6346
  mature of SEQ ID 4980

SEQ ID NO: 7441 - DNA, 23 bp, Homo sapiens
  mature of SEQ ID 4980
tattgattaagttgttccagttt

SEQ ID NO: 7442 - DNA, 32 bp, Homo sapiens
  mature of SEQ ID 4823
atgcctcataaactttaaattcttgcgcaggg

SEQ ID NO: 7443 - DNA, 31 bp, Homo sapiens
  mature of SEQ ID 5146
aggtttgtttgtttaggtctctttttatttg

SEQ ID NO: 7444 - DNA, 31 bp, Homo sapiens
  mature of SEQ ID 4891
ctgcgcctgtgtgtgagctaattaatctcag

SEQ ID NO: 7445 - DNA, 26 bp, Homo sapiens
  mature of SEQ ID 5486
acttcagacagagaactatttgaagc

SEQ ID NO: 7446 - DNA, 22 bp, Homo sapiens
  mature of SEQ ID 5486
gccagatgttgtgtctgaattg

SEQ ID NO: 7447 - DNA, 19 bp, Homo sapiens
  mature of SEQ ID 4741
gactctcgtccatgttcag

SEQ ID NO: 7448 - DNA, 28 bp, Homo sapiens
  mature of SEQ ID 4741
tctggtaggacagctcgaacatggtgca

SEQ ID NO: 7449 - DNA, 30 bp, Homo sapiens
  mature of SEQ ID 4058
cgctgccaccactgccgccggctccggccc

SEQ ID NO: 7450 - DNA, 25 bp, Homo sapiens
  mature of SEQ ID 4058
gggctggaaaaggggcgcggtgagc

SEQ ID NO: 7451 - DNA, 33 bp, Homo sapiens
  mature of SEQ ID 5030
aattacagatgggatccagtaaaagacactgta

SEQ ID NO: 7452 - DNA, 30 bp, Homo sapiens
  mature of SEQ ID 5030
ctgggaattacagatgggatccagtaaaag

SEQ ID NO: 7453 - DNA, 27 bp, Homo sapiens
  mature of SEQ ID 5030
tatattgttttccatggaacttttcta

SEQ ID NO: 7454 - DNA, 31 bp, Homo sapiens
  mature of SEQ ID 4624
aaggagtgagtggatggcacaactggtttgg

SEQ ID NO: 7455 - DNA, 30 bp, Homo sapiens
  mature of SEQ ID 4624
tcttccagttgtccacaacctcacaaggcc

SEQ ID NO: 7456 - DNA, 33 bp, Homo sapiens
  mature of SEQ ID 4624
cagttgtccacaacctcacaaggccagagaagc

SEQ ID NO: 7457 - DNA, 28 bp, Homo sapiens
  mature of SEQ ID 4219
aatcaatctgtcagaggcaatgaggagg

SEQ ID NO: 7458 - DNA, 23 bp, Homo sapiens
  mature of SEQ ID 5201
aatatcatgaaccatgttttgat

SEQ ID NO: 7459 - DNA, 32 bp, Homo sapiens
  mature of SEQ ID 5201
ggaatagggtgtttgatatttcttcatatgtt

SEQ ID NO: 7460 - DNA, 29 bp, Homo sapiens
  mature of SEQ ID 5201
caacggaatagggtgtttgatatttcttc

SEQ ID NO: 7461 - DNA, 24 bp, Homo sapiens
  mature of SEQ ID 5599
gagtctcaccatggatcttccatt

SEQ ID NO: 7462 - DNA, 29 bp, Homo sapiens
  mature of SEQ ID 5599
acaagaagaggaagtctccatggagagtt

SEQ ID NO: 7463 - DNA, 31 bp, Homo sapiens
  mature of SEQ ID 4226
gctcacgtcgatggccagcgagcgcaggtgc

SEQ ID NO: 7464 - DNA, 32 bp, Homo sapiens
  mature of SEQ ID 4226
gcactcgctgctcagctggctggcgtcgaagc

SEQ ID NO: 7465 - DNA, 22 bp, Homo sapiens
  mature of SEQ ID 5264
cctgtcatgtaatatgattaca

SEQ ID NO: 7466 - DNA, 31 bp, Homo sapiens
  mature of SEQ ID 5264
gtctgagtttcccaaattaggttattgtgtc

SEQ ID NO: 7467 - DNA, 20 bp, Homo sapiens
  mature of SEQ ID 4070
tttaccaggtgtttggttaa

SEQ ID NO: 7468 - DNA, 30 bp, Homo sapiens
  mature of SEQ ID 4070
gctgtatttcccaacttggagattttgcaa

SEQ ID NO: 7469 - DNA, 27 bp, Homo sapiens
  mature of SEQ ID 4470
tcaccaattttagagcaccaagaattg

SEQ ID NO: 7470 - DNA, 21 bp, Homo sapiens
  mature of SEQ ID 5507
ctgtggctttgccagaggctg

SEQ ID NO: 7471 - DNA, 33 bp, Homo sapiens
  mature of SEQ ID 5507
ctcccaggcttcctgccattgacaaggccacag

SEQ ID NO: 7472 - DNA, 20 bp, Homo sapiens
  mature of SEQ ID 4044
ccccctgggagggaggggag

SEQ ID NO: 7473 - DNA, 33 bp, Homo sapiens
  mature of SEQ ID 5690
tcatattcaattacgctgtttagagttaatatt

SEQ ID NO: 7474 - DNA, 30 bp, Homo sapiens
  mature of SEQ ID 5690
tagtttcatattcaattacgctgtttagag

SEQ ID NO: 7475 - DNA, 32 bp, Homo sapiens
  mature of SEQ ID 5690
tgctctatttagctttattattgtattatgga

SEQ ID NO: 7476 - DNA, 30 bp, Homo sapiens
  mature of SEQ ID 5690
aatattgctctatttagctttattattgta

SEQ ID NO: 7477 - DNA, 23 bp, Homo sapiens
  mature of SEQ ID 5714
cttgatcatggaggattttattt

SEQ ID NO: 7478 - DNA, 29 bp, Homo sapiens
  mature of SEQ ID 5714
agtagatgaggagcaaatgagaatcttgg

SEQ ID NO: 7479 - DNA, 33 bp, Homo sapiens
  mature of SEQ ID 5256
gggcagcagggctggtctgggcacagactgaca

SEQ ID NO: 7480 - DNA, 22 bp, Homo sapiens
  mature of SEQ ID 4713
ggggaacaggtcttggggtcat

SEQ ID NO: 7481 - DNA, 31 bp, Homo sapiens
  mature of SEQ ID 4713
cccagggcctgtctcccttcttgggtagggc

SEQ ID NO: 7482 - DNA, 29 bp, Homo sapiens
  mature of SEQ ID 4713
tgaccccagggcctgtctcccttcttggg

SEQ ID NO: 7483 - DNA, 30 bp, Homo sapiens
  mature of SEQ ID 5492
gctgcttgaaatacctgataatacctttga

SEQ ID NO: 7484 - DNA, 32 bp, Homo sapiens
  mature of SEQ ID 5492
ttgaaatacctgataatacctttgacactggc

SEQ ID NO: 7485 - DNA, 30 bp, Homo sapiens
  mature of SEQ ID 4159
cacccaaccttctcttccctagagggtagt

SEQ ID NO: 7486 - DNA, 32 bp, Homo sapiens
  mature of SEQ ID 4159
gctacaccctatggggcagagaggaaagggtg

SEQ ID NO: 7487 - DNA, 18 bp, Homo sapiens
  mature of SEQ ID 4104
ggagcggcgcccggcccg

SEQ ID NO: 7488 - DNA, 31 bp, Homo sapiens
  mature of SEQ ID 4104
cggctgtggctgggccagggcggggcgcgct

SEQ ID NO: 7489 - DNA, 29 bp, Homo sapiens
  mature of SEQ ID 4833
caagcagcagccagttatgatgacaggtg

SEQ ID NO: 7490 - DNA, 29 bp, Homo sapiens
  mature of SEQ ID 4471
gatttagatgtttaatagaaagtaaacgt

SEQ ID NO: 7491 - DNA, 32 bp, Homo sapiens
  mature of SEQ ID 4471
gctttggtttctgctgaacctgtatttaaatc

SEQ ID NO: 7492 - DNA, 33 bp, Homo sapiens
  mature of SEQ ID 4418
gggacggtttgaggaccgggctcggccgaggag

SEQ ID NO: 7493 - DNA, 18 bp, Homo sapiens
  mature of SEQ ID 4418
ctccctggcccccggtcc

SEQ ID NO: 7494 - DNA, 33 bp, Homo sapiens
  mature of SEQ ID 5231
ggatttttcagcagccacaaagtttgtattgtt

SEQ ID NO: 7495 - DNA, 29 bp, Homo sapiens
  mature of SEQ ID 4641
agtgtattttctcgttgaatactggaatt

SEQ ID NO: 7496 - DNA, 20 bp, Homo sapiens
  mature of SEQ ID 4667
atgaatcattggtgagcttt

SEQ ID NO: 7497 - DNA, 25 bp, Homo sapiens
  mature of SEQ ID 4667
aaaatggcatttatactggaaacct

SEQ ID NO: 7498 - DNA, 18 bp, Homo sapiens
  mature of SEQ ID 5312
ttagagaatcaattcact

SEQ ID NO: 7499 - DNA, 23 bp, Homo sapiens
  mature of SEQ ID 5312
acaaagttgcagatagtaagtaa

SEQ ID NO: 7500 - DNA, 24 bp, Homo sapiens
  mature of SEQ ID 4427
gaggaggcccacgcgctccagctg

SEQ ID NO: 7501 - DNA, 18 bp, Homo sapiens
  mature of SEQ ID 4427
agcccgtccacgttctgg

SEQ ID NO: 7502 - DNA, 23 bp, Homo sapiens
  mature of SEQ ID 4427
ctggggaagcctgagcgcacatg

SEQ ID NO: 7503 - DNA, 29 bp, Homo sapiens
  mature of SEQ ID 5491
gcagatttagctagtttccaaatggaaag

SEQ ID NO: 7504 - DNA, 21 bp, Homo sapiens
  mature of SEQ ID 5491
ctgtttggaggttaaatttgc

SEQ ID NO: 7505 - DNA, 32 bp, Homo sapiens
  mature of SEQ ID 4536
agcctccggcctttactggtgtactgcaggcc

SEQ ID NO: 7506 - DNA, 21 bp, Homo sapiens
  mature of SEQ ID 4200
atgctgggggcactttacatg

SEQ ID NO: 7507 - DNA, 17 bp, Homo sapiens
  mature of SEQ ID 4200
gcctgttgtttcactgt

SEQ ID NO: 7508 - DNA, 18 bp, Homo sapiens
  mature of SEQ ID 4944
tgtcagaacttggtaatg

SEQ ID NO: 7509 - DNA, 31 bp, Homo sapiens
  mature of SEQ ID 4944
catttatcaagcccgttctccatgagaaagg

SEQ ID NO: 7510 - DNA, 21 bp, Homo sapiens
  mature of SEQ ID 5535
gactgggagggtttcttttcc

SEQ ID NO: 7511 - DNA, 27 bp, Homo sapiens
  mature of SEQ ID 5535
ggaaagcctatttttcttattgtgttc

SEQ ID NO: 7512 - DNA, 32 bp, Homo sapiens
  mature of SEQ ID 4581
ttccttataatgccctaaggatgtgattatct

SEQ ID NO: 7513 - DNA, 29 bp, Homo sapiens
  mature of SEQ ID 4581
gtctttccttataatgccctaaggatgtg

SEQ ID NO: 7514 - DNA, 27 bp, Homo sapiens
  mature of SEQ ID 4581
aggcaatcacactcctggggattatag

SEQ ID NO: 7515 - DNA, 22 bp, Homo sapiens
  mature of SEQ ID 5219
gtttttctgcgtcatctgggaa

SEQ ID NO: 7516 - DNA, 28 bp, Homo sapiens
  mature of SEQ ID 5384
agagaaacacaagagcaaggtgctgagg

SEQ ID NO: 7517 - DNA, 24 bp, Homo sapiens
  mature of SEQ ID 5272
gaatgattaatgtaagcccttctg

SEQ ID NO: 7518 - DNA, 18 bp, Homo sapiens
  mature of SEQ ID 5272
ggaattcttttctgcagc

SEQ ID NO: 7519 - DNA, 29 bp, Homo sapiens
  mature of SEQ ID 4561
gcatttttaaacaaaactgctttcctgac

SEQ ID NO: 7520 - DNA, 32 bp, Homo sapiens
  mature of SEQ ID 4561
ttttaaacaaaactgctttcctgaccgtaact

SEQ ID NO: 7521 - DNA, 18 bp, Homo sapiens
  mature of SEQ ID 4126
ggaggtggaagagatgga

SEQ ID NO: 7522 - DNA, 36 bp, Homo sapiens
  mature of SEQ ID 5307
caaaatcaaataacccatttgaagaagtggagtggt

SEQ ID NO: 7523 - DNA, 33 bp, Homo sapiens
  mature of SEQ ID 5307
caattaagcaaaatcaaataacccatttgaaga

SEQ ID NO: 7524 - DNA, 17 bp, Homo sapiens
  mature of SEQ ID 5307
accttttccttcttgtt

SEQ ID NO: 7525 - DNA, 29 bp, Homo sapiens
  mature of SEQ ID 5365
gctcccgcaaggccctttgctgcctgcaa

SEQ ID NO: 7526 - DNA, 22 bp, Homo sapiens
  mature of SEQ ID 5365
ggcccctgacctcagcactggc

SEQ ID NO: 7527 - DNA, 27 bp, Homo sapiens
  mature of SEQ ID 5587
tccatgtgaataatgcatttaatgcca

SEQ ID NO: 7528 - DNA, 22 bp, Homo sapiens
  mature of SEQ ID 5029
gacatctggggaccaagtaaga

SEQ ID NO: 7529 - DNA, 17 bp, Homo sapiens
  mature of SEQ ID 4091
ggccgcgggccgcgggc

SEQ ID NO: 7530 - DNA, 30 bp, Homo sapiens
  mature of SEQ ID 4374
gccaactctctttgggcagctcaattttca

SEQ ID NO: 7531 - DNA, 17 bp, Homo sapiens
  mature of SEQ ID 4374
agctgtcaagagtccta

SEQ ID NO: 7532 - DNA, 22 bp, Homo sapiens
  mature of SEQ ID 5541
taattagtctagagtgaatctt

SEQ ID NO: 7533 - DNA, 21 bp, Homo sapiens
  mature of SEQ ID 5541
gttcacacactagagtaatta

SEQ ID NO: 7534 - DNA, 25 bp, Homo sapiens
  mature of SEQ ID 4576
aatacttgttttgcctttcatgaat

SEQ ID NO: 7535 - DNA, 28 bp, Homo sapiens
  mature of SEQ ID 4576
tgaaaggtttatagcttattcttgatgt

SEQ ID NO: 7536 - DNA, 35 bp, Homo sapiens
  mature of SEQ ID 5096
atgggttttggattaagaacttggtaacaaagcag

SEQ ID NO: 7537 - DNA, 33 bp, Homo sapiens
  mature of SEQ ID 5096
cagcatgaatgggttttggattaagaacttggt

SEQ ID NO: 7538 - DNA, 25 bp, Homo sapiens
  mature of SEQ ID 5096
ctctttcctcacttctttctttcat

SEQ ID NO: 7539 - DNA, 34 bp, Homo sapiens
  mature of SEQ ID 5298
gagctccaaccagtacaggaataatggtaaactc

SEQ ID NO: 7540 - DNA, 30 bp, Homo sapiens
  mature of SEQ ID 5298
gagttttccgaattcctgttcttttgactc

SEQ ID NO: 7541 - DNA, 20 bp, Homo sapiens
  mature of SEQ ID 5055
catgtaaaagtctggatata

SEQ ID NO: 7542 - DNA, 18 bp, Homo sapiens
  mature of SEQ ID 5055
tttttcacggattgttta

SEQ ID NO: 7543 - DNA, 20 bp, Homo sapiens
  mature of SEQ ID 4998
gaatgattgctcaacttgaa

SEQ ID NO: 7544 - DNA, 25 bp, Homo sapiens
  mature of SEQ ID 4998
gtctggggtggtttggatcattgcg

SEQ ID NO: 7545 - DNA, 29 bp, Homo sapiens
  mature of SEQ ID 5655
tctgcatcctgtcagcaatgcctggatac

SEQ ID NO: 7546 - DNA, 31 bp, Homo sapiens; identical to SEQ ID NO: 7353
  mature of SEQ ID 5655

SEQ ID NO: 7547 - DNA, 33 bp, Homo sapiens; identical to SEQ ID NO: 7351
  mature of SEQ ID 5655

SEQ ID NO: 7548 - DNA, 31 bp, Homo sapiens; identical to SEQ ID NO: 7352
  mature of SEQ ID 5655

SEQ ID NO: 7549 - DNA, 17 bp, Homo sapiens
  mature of SEQ ID 5189
aatctggcagcagactt

SEQ ID NO: 7550 - DNA, 35 bp, Homo sapiens
  mature of SEQ ID 5189
tctctgcctctccattccattcccttcttgtttgt

SEQ ID NO: 7551 - DNA, 33 bp, Homo sapiens
  mature of SEQ ID 5189
cttaatattctctgcctctccattccattccct

SEQ ID NO: 7552 - DNA, 18 bp, Homo sapiens
  mature of SEQ ID 5189
acaaacattgagtcttag

SEQ ID NO: 7553 - DNA, 28 bp, Homo sapiens
  mature of SEQ ID 5325
catgttaattaaagcagaggctaatgtt

SEQ ID NO: 7554 - DNA, 31 bp, Homo sapiens
  mature of SEQ ID 5325
ttaatgttggttaatgctttgctaattaaag

SEQ ID NO: 7555 - DNA, 21 bp, Homo sapiens
  mature of SEQ ID 5482
tcatcttttcttttccctaat

SEQ ID NO: 7556 - DNA, 17 bp, Homo sapiens
  mature of SEQ ID 5482
agagatcgctcaggggt

SEQ ID NO: 7557 - DNA, 17 bp, Homo sapiens
  mature of SEQ ID 4979
actcggttttgtcctta

SEQ ID NO: 7558 - DNA, 28 bp, Homo sapiens
  mature of SEQ ID 4979
gacttggaaggtgagccctctggggaca

SEQ ID NO: 7559 - DNA, 17 bp, Homo sapiens
  mature of SEQ ID 4853
ttctctgctggaaatag

SEQ ID NO: 7560 - DNA, 17 bp, Homo sapiens
  mature of SEQ ID 4853
aattttccagtgagcaa

SEQ ID NO: 7561 - DNA, 33 bp, Homo sapiens
  mature of SEQ ID 5122
acagctgtgtttttgtagctgtgaaatttagtc

SEQ ID NO: 7562 - DNA, 31 bp, Homo sapiens
  mature of SEQ ID 5122
tatttcacagctgtgtttttgtagctgtgaa

SEQ ID NO: 7563 - DNA, 18 bp, Homo sapiens
  mature of SEQ ID 5128
ctgtcctttctctgaggt

SEQ ID NO: 7564 - DNA, 23 bp, Homo sapiens
  mature of SEQ ID 5128
ccacgtgggcagaattctgtgca

SEQ ID NO: 7565 - DNA, 28 bp, Homo sapiens
  mature of SEQ ID 4346
atgatgtttatttcgggttactatttgg

SEQ ID NO: 7566 - DNA, 18 bp, Homo sapiens
  mature of SEQ ID 4477
gaaaacctcaagcctgtt

SEQ ID NO: 7567 - DNA, 19 bp, Homo sapiens
  mature of SEQ ID 4477
aacaggcccagaattctgt

SEQ ID NO: 7568 - DNA, 17 bp, Homo sapiens
  mature of SEQ ID 4477
atctagaaggtgaataa

SEQ ID NO: 7569 - DNA, 24 bp, Homo sapiens
  mature of SEQ ID 4882
tgtcactgattatgaaattgttaa

SEQ ID NO: 7570 - DNA, 24 bp, Homo sapiens
  mature of SEQ ID 4882
cctctttgcattttggatcaaaga

SEQ ID NO: 7571 - DNA, 17 bp, Homo sapiens
  mature of SEQ ID 4238
atcttggattgtggcct

SEQ ID NO: 7572 - DNA, 27 bp, Homo sapiens
  mature of SEQ ID 4238
ctcatagtagaaactgtggctacatct

SEQ ID NO: 7573 - DNA, 20 bp, Homo sapiens
  mature of SEQ ID 4829
ttccagtctggaatctttga

SEQ ID NO: 7574 - DNA, 20 bp, Homo sapiens
  mature of SEQ ID 4829
cctaatttcaagttggaagg

SEQ ID NO: 7575 - DNA, 20 bp, Homo sapiens
  mature of SEQ ID 5618
ccagagagctaaaagggcag

SEQ ID NO: 7576 - DNA, 18 bp, Homo sapiens
  mature of SEQ ID 5666
tttgggctcaatttacag

SEQ ID NO: 7577 - DNA, 25 bp, Homo sapiens
  mature of SEQ ID 5666
gagaaggcccagaggagattaatca

SEQ ID NO: 7578 - DNA, 26 bp, Homo sapiens
  mature of SEQ ID 5496
ccctcttcccagcactaccaggcagg

SEQ ID NO: 7579 - DNA, 24 bp, Homo sapiens
  mature of SEQ ID 5544
cagagccctgtggctctgcgcatg

SEQ ID NO: 7580 - DNA, 29 bp, Homo sapiens
  mature of SEQ ID 5115
gcctacattttcttactttcacaaggaca

SEQ ID NO: 7581 - DNA, 32 bp, Homo sapiens
  mature of SEQ ID 5115
acattttcttactttcacaaggacatttgcta

SEQ ID NO: 7582 - DNA, 22 bp, Homo sapiens
  mature of SEQ ID 5115
cacatcgccaatgttcttacaa

SEQ ID NO: 7583 - DNA, 18 bp, Homo sapiens
  mature of SEQ ID 5115
gaaggaaatatacaaagc

SEQ ID NO: 7584 - DNA, 26 bp, Homo sapiens
  mature of SEQ ID 5421
caataatgacctcagaagggctcatt

SEQ ID NO: 7585 - DNA, 21 bp, Homo sapiens
  mature of SEQ ID 5421
tgcatcttcgggcattatatg

SEQ ID NO: 7586 - DNA, 35 bp, Homo sapiens
  mature of SEQ ID 5269
cagccataaacagacctcccaggatttttccagag

SEQ ID NO: 7587 - DNA, 33 bp, Homo sapiens
  mature of SEQ ID 5269
ctttgctacagccataaacagacctcccaggat

SEQ ID NO: 7588 - DNA, 23 bp, Homo sapiens
  mature of SEQ ID 4566
acttgacaaagtcaaaatgctct

SEQ ID NO: 7589 - DNA, 19 bp, Homo sapiens
  mature of SEQ ID 4566
tattacaatgacagaagag

SEQ ID NO: 7590 - DNA, 18 bp, Homo sapiens
  mature of SEQ ID 4566
attttaattttgtccagt

SEQ ID NO: 7591 - DNA, 25 bp, Homo sapiens
  mature of SEQ ID 4324
gtttctgactcttaaccccaactcc

SEQ ID NO: 7592 - DNA, 23 bp, Homo sapiens
  mature of SEQ ID 4324
ccctgttttaagagttttaggag

SEQ ID NO: 7593 - DNA, 19 bp, Homo sapiens
  mature of SEQ ID 4444
tcagcaggtaggtgttagc

SEQ ID NO: 7594 - DNA, 30 bp, Homo sapiens
  mature of SEQ ID 4444
gctctacgtatctgtttggttttcacactg

SEQ ID NO: 7595 - DNA, 32 bp, Homo sapiens
  mature of SEQ ID 4444
acgtatctgtttggttttcacactgtagatga

SEQ ID NO: 7596 - DNA, 17 bp, Homo sapiens
  mature of SEQ ID 4379
gtatctgtgaaagtgtg

SEQ ID NO: 7597 - DNA, 17 bp, Homo sapiens
  mature of SEQ ID 4379
acacggtatactgtgtc

SEQ ID NO: 7598 - DNA, 22 bp, Homo sapiens
  mature of SEQ ID 4379
ggtggaagcagcctggcaacat

SEQ ID NO: 7599 - DNA, 30 bp, Homo sapiens
  mature of SEQ ID 4580
ggatgctgagacttctctcctgaccttggg

SEQ ID NO: 7600 - DNA, 32 bp, Homo sapiens
  mature of SEQ ID 4580
ctgagacttctctcctgaccttgggccaagac

SEQ ID NO: 7601 - DNA, 25 bp, Homo sapiens
  mature of SEQ ID 4449
gttgacatacatcacaaactattca

SEQ ID NO: 7602 - DNA, 27 bp, Homo sapiens
  mature of SEQ ID 4791
ccttgtacttcatctacccccaggggc

SEQ ID NO: 7603 - DNA, 24 bp, Homo sapiens
  mature of SEQ ID 4791
gcccctaggcatggagtatgaggc

SEQ ID NO: 7604 - DNA, 29 bp, Homo sapiens
  mature of SEQ ID 5282
tcatgctctacttgtcctaggctgatatt

SEQ ID NO: 7605 - DNA, 32 bp, Homo sapiens
  mature of SEQ ID 5282
gctctacttgtcctaggctgatattaacgaaa

SEQ ID NO: 7606 - DNA, 30 bp, Homo sapiens
  mature of SEQ ID 5282
ttttgtgctaatcagccttagcgttcagca

SEQ ID NO: 7607 - DNA, 32 bp, Homo sapiens
  mature of SEQ ID 5282
tgctaatcagccttagcgttcagcatgcatga

SEQ ID NO: 7608 - DNA, 18 bp, Homo sapiens
  mature of SEQ ID 4236
gggagataattgctgggt

SEQ ID NO: 7609 - DNA, 18 bp, Homo sapiens
  mature of SEQ ID 4236
tctccagcgcgttcgtgg

SEQ ID NO: 7610 - DNA, 17 bp, Homo sapiens
  mature of SEQ ID 4236
acccatctgtacctttc

SEQ ID NO: 7611 - DNA, 29 bp, Homo sapiens
  mature of SEQ ID 5060
cagtgggagttttgcttgagtgaagagaa

SEQ ID NO: 7612 - DNA, 34 bp, Homo sapiens
  mature of SEQ ID 5060
taatctcatttgtttcactcaggcagaacactta

SEQ ID NO: 7613 - DNA, 32 bp, Homo sapiens
  mature of SEQ ID 5060
atgggcctaatctcatttgtttcactcaggca

SEQ ID NO: 7614 - DNA, 22 bp, Homo sapiens
  mature of SEQ ID 5294
acttggataaaatctgatttag

SEQ ID NO: 7615 - DNA, 32 bp, Homo sapiens
  mature of SEQ ID 5294
agaaaaggaaatgagatgtgtaggcttgtagt

SEQ ID NO: 7616 - DNA, 30 bp, Homo sapiens
  mature of SEQ ID 5071
gctggtcagagtccagtctactttccactt

SEQ ID NO: 7617 - DNA, 25 bp, Homo sapiens
  mature of SEQ ID 5706
aataggcttctaactaatgggaata

SEQ ID NO: 7618 - DNA, 23 bp, Homo sapiens
  mature of SEQ ID 5376
ttccttccttgttcccagcagaa

SEQ ID NO: 7619 - DNA, 19 bp, Homo sapiens
  mature of SEQ ID 5369
ggggaccatgtgtcagtct

SEQ ID NO: 7620 - DNA, 17 bp, Homo sapiens
  mature of SEQ ID 5077
aaagggcactaggcatg

SEQ ID NO: 7621 - DNA, 32 bp, Homo sapiens
  mature of SEQ ID 5077
cttcatgggaaatgcttagttgagtccactga

SEQ ID NO: 7622 - DNA, 24 bp, Homo sapiens
  mature of SEQ ID 5094
tccaatcaggcacgcaaagaagaa

SEQ ID NO: 7623 - DNA, 32 bp, Homo sapiens
  mature of SEQ ID 5094
gtcatgccctgcgtagcctttggtgggatcca

SEQ ID NO: 7624 - DNA, 29 bp, Homo sapiens
  mature of SEQ ID 4321
agagaaattatgagattgctgacttcaaa

SEQ ID NO: 7625 - DNA, 32 bp, Homo sapiens
  mature of SEQ ID 4321
aaattatgagattgctgacttcaaaggtttcc

SEQ ID NO: 7626 - DNA, 26 bp, Homo sapiens
  mature of SEQ ID 4321
aaaatgcctgtaattttattttctct

SEQ ID NO: 7627 - DNA, 26 bp, Homo sapiens
  mature of SEQ ID 5565
ggcgccccacccccgccctgccccca

SEQ ID NO: 7628 - DNA, 30 bp, Homo sapiens
  mature of SEQ ID 4750
cctcctacctccttttggctttctcttctg

SEQ ID NO: 7629 - DNA, 22 bp, Homo sapiens
  mature of SEQ ID 4750
cagatatccagccaggaagtgc

SEQ ID NO: 7630 - DNA, 23 bp, Homo sapiens
  mature of SEQ ID 4437
gtggcggagtcgatgctgctcgt

SEQ ID NO: 7631 - DNA, 25 bp, Homo sapiens
  mature of SEQ ID 4437
cacgctgcagcacactctcgccctt

SEQ ID NO: 7632 - DNA, 19 bp, Homo sapiens
  mature of SEQ ID 5273
gcgtgcatgcatacactca

SEQ ID NO: 7633 - DNA, 21 bp, Homo sapiens
  mature of SEQ ID 5273
ggcattcaattatgttttgct

SEQ ID NO: 7634 - DNA, 22 bp, Homo sapiens
  mature of SEQ ID 5273
gtgtgattacaattgtaccctt

SEQ ID NO: 7635 - DNA, 32 bp, Homo sapiens
  mature of SEQ ID 5651
ttgaattacacaggacaataattagacccaga

SEQ ID NO: 7636 - DNA, 29 bp, Homo sapiens
  mature of SEQ ID 5651
cccattgaattacacaggacaataattag

SEQ ID NO: 7637 - DNA, 19 bp, Homo sapiens
  mature of SEQ ID 4811
ggaaccaaattgcagtttt

SEQ ID NO: 7638 - DNA, 29 bp, Homo sapiens
  mature of SEQ ID 5597
gctgccacggcttaaattaaatgtgccac

SEQ ID NO: 7639 - DNA, 29 bp, Homo sapiens
  mature of SEQ ID 5597
gtggcacttgtatgtaatttattatggct

SEQ ID NO: 7640 - DNA, 31 bp, Homo sapiens
  mature of SEQ ID 4776
agcctcctgctgggttaagtgtgagctaagt

SEQ ID NO: 7641 - DNA, 31 bp, Homo sapiens
  mature of SEQ ID 5718
atctggaagccattcatggcctggatggcag

SEQ ID NO: 7642 - DNA, 29 bp, Homo sapiens
  mature of SEQ ID 5718
gccgatctggaagccattcatggcctgga

SEQ ID NO: 7643 - DNA, 30 bp, Homo sapiens
  mature of SEQ ID 5718
tggcatccttaggccgctttagctggactt

SEQ ID NO: 7644 - DNA, 33 bp, Homo sapiens
  mature of SEQ ID 5718
tccttaggccgctttagctggactttgaggcgc

SEQ ID NO: 7645 - DNA, 28 bp, Homo sapiens
  mature of SEQ ID 5179
agaggggcagcaggttttgacagaggct

SEQ ID NO: 7646 - DNA, 19 bp, Homo sapiens
  mature of SEQ ID 5179
tttctcactctctgctgtt

SEQ ID NO: 7647 - DNA, 32 bp, Homo sapiens
  mature of SEQ ID 4514
gcagctgggcggaggacgtgggtgtgggatgc

SEQ ID NO: 7648 - DNA, 20 bp, Homo sapiens
  mature of SEQ ID 4514
ccttctcctcactcttgttc

SEQ ID NO: 7649 - DNA, 22 bp, Homo sapiens
  mature of SEQ ID 4355
ggggccgcaacgagcccccgct

SEQ ID NO: 7650 - DNA, 17 bp, Homo sapiens
  mature of SEQ ID 4355
cttatctgcgtttggca

SEQ ID NO: 7651 - DNA, 25 bp, Homo sapiens
  mature of SEQ ID 4845
cacagaaattcaggagggatttcat

SEQ ID NO: 7652 - DNA, 19 bp, Homo sapiens
  mature of SEQ ID 4845
atgtaaatcctttctgatt

SEQ ID NO: 7653 - DNA, 22 bp, Homo sapiens
  mature of SEQ ID 5647
attataatgaatgcatcaaaaa

SEQ ID NO: 7654 - DNA, 18 bp, Homo sapiens
  mature of SEQ ID 5647
tttttgtgtttagtcttc

SEQ ID NO: 7655 - DNA, 18 bp, Homo sapiens
  mature of SEQ ID 5107
atgtccaaattgacagta

SEQ ID NO: 7656 - DNA, 21 bp, Homo sapiens
  mature of SEQ ID 5107
ggcttccatgtactgcagtaa

SEQ ID NO: 7657 - DNA, 23 bp, Homo sapiens
  mature of SEQ ID 4297
agataaaagctaaagacctttta

SEQ ID NO: 7658 - DNA, 20 bp, Homo sapiens
  mature of SEQ ID 4297
aactaaaggaactttctcaa

SEQ ID NO: 7659 - DNA, 27 bp, Homo sapiens
  mature of SEQ ID 5604
gtgtttacttgtaactttctggttata

SEQ ID NO: 7660 - DNA, 34 bp, Homo sapiens
  mature of SEQ ID 5604
tatatctgtggattcaagttactgaagtgaatac

SEQ ID NO: 7661 - DNA, 26 bp, Homo sapiens
  mature of SEQ ID 4697
gtccccaaagggatatttcagcacag

SEQ ID NO: 7662 - DNA, 30 bp, Homo sapiens
  mature of SEQ ID 4697
acacacgctactgcaggctagagatcttat

SEQ ID NO: 7663 - DNA, 18 bp, Homo sapiens
  mature of SEQ ID 5688
ctttctgcaccctcaggg

SEQ ID NO: 7664 - DNA, 29 bp, Homo sapiens
  mature of SEQ ID 5688
cgtggcagggttaacagccactgagggtg

SEQ ID NO: 7665 - DNA, 25 bp, Homo sapiens
  mature of SEQ ID 4866
tgctgccatgttcttctgggtcata

SEQ ID NO: 7666 - DNA, 31 bp, Homo sapiens
  mature of SEQ ID 4866
tgcagggtgtaggatcccaggagagcatgag

SEQ ID NO: 7667 - DNA, 22 bp, Homo sapiens
  mature of SEQ ID 4547
acaggttttcaggaggcctgat

SEQ ID NO: 7668 - DNA, 23 bp, Homo sapiens
  mature of SEQ ID 4547
cagcggatgggcctcctacttgt

SEQ ID NO: 7669 - DNA, 26 bp, Homo sapiens
  mature of SEQ ID 4441
gtgactcctgcactaagagccatagg

SEQ ID NO: 7670 - DNA, 30 bp, Homo sapiens
  mature of SEQ ID 4130
tgtattaatttaggagaaatgtgcactggc

SEQ ID NO: 7671 - DNA, 32 bp, Homo sapiens
  mature of SEQ ID 4130
tgcactcttcttaattatcttacagtccccat

SEQ ID NO: 7672 - DNA, 34 bp, Homo sapiens
  mature of SEQ ID 5596
ccgggcagcctgatcactgactattgcaaactgc

SEQ ID NO: 7673 - DNA, 32 bp, Homo sapiens
  mature of SEQ ID 5596
gtatagtaattgtcagtcatctaaggtagccc

SEQ ID NO: 7674 - DNA, 34 bp, Homo sapiens
  mature of SEQ ID 5033
actctgcaattaagatgtaaatttggttgtgagc

SEQ ID NO: 7675 - DNA, 32 bp, Homo sapiens
  mature of SEQ ID 5033
aatgtgaactctgcaattaagatgtaaatttg

SEQ ID NO: 7676 - DNA, 34 bp, Homo sapiens
  mature of SEQ ID 5033
gcttaattaccagtagcattatgctgtctatatt

SEQ ID NO: 7677 - DNA, 25 bp, Homo sapiens
  mature of SEQ ID 4634
cttccctaatttaaagccatgttga

SEQ ID NO: 7678 - DNA, 32 bp, Homo sapiens
  mature of SEQ ID 4634
tcattgtgacttttgttcttagggaagcagag

SEQ ID NO: 7679 - DNA, 32 bp, Homo sapiens
  mature of SEQ ID 5411
cccaactggtttatgtcagcattttggaaaga

SEQ ID NO: 7680 - DNA, 30 bp, Homo sapiens
  mature of SEQ ID 4817
attggctctcttcttcaaaggaccaggtcc

SEQ ID NO: 7681 - DNA, 28 bp, Homo sapiens
  mature of SEQ ID 4817
cccagctccctgtgaagagagagttaat

SEQ ID NO: 7682 - DNA, 25 bp, Homo sapiens
  mature of SEQ ID 4923
aaaactcccaaattcatgagcaatg

SEQ ID NO: 7683 - DNA, 28 bp, Homo sapiens
  mature of SEQ ID 4923
cctatttatcttcacatgtttaagtttt

SEQ ID NO: 7684 - DNA, 20 bp, Homo sapiens
  mature of SEQ ID 4362
gagggagagcctttgaagcc

SEQ ID NO: 7685 - DNA, 32 bp, Homo sapiens
  mature of SEQ ID 4362
aacagaactttccacctgagagacgctggaga

SEQ ID NO: 7686 - DNA, 30 bp, Homo sapiens
  mature of SEQ ID 4362
ggctgaacagaactttccacctgagagacg

SEQ ID NO: 7687 - DNA, 22 bp, Homo sapiens
  mature of SEQ ID 5578
ggagtctttatagtgcaggagg

SEQ ID NO: 7688 - DNA, 19 bp, Homo sapiens
  mature of SEQ ID 4287
gggtgaaggcgcaggcgat

SEQ ID NO: 7689 - DNA, 22 bp, Homo sapiens
  mature of SEQ ID 5225
cctgactcttgctcttaagtca

SEQ ID NO: 7690 - DNA, 23 bp, Homo sapiens
  mature of SEQ ID 5225
attgtacaagttcctgtttggac

SEQ ID NO: 7691 - DNA, 23 bp, Homo sapiens
  mature of SEQ ID 5357
gaaggtcctggaggccagcaggg

SEQ ID NO: 7692 - DNA, 21 bp, Homo sapiens
  mature of SEQ ID 4348
aggaggccacagcgctggcct

SEQ ID NO: 7693 - DNA, 28 bp, Homo sapiens
  mature of SEQ ID 4872
ggttgcctgggagatgacctctttcggg

SEQ ID NO: 7694 - DNA, 19 bp, Homo sapiens
  mature of SEQ ID 5408
ttttaatgaggcttctaga

SEQ ID NO: 7695 - DNA, 18 bp, Homo sapiens
  mature of SEQ ID 5408
tttaatgattttgttttg

SEQ ID NO: 7696 - DNA, 34 bp, Homo sapiens
  mature of SEQ ID 4964
aaggccactggacacagaatctgtgtgatgctgt

SEQ ID NO: 7697 - DNA, 25 bp, Homo sapiens
  mature of SEQ ID 5319
agagaacaaggggctgctccgaccc

SEQ ID NO: 7698 - DNA, 22 bp, Homo sapiens
  mature of SEQ ID 5566
gtagagaggctttctggctggg

SEQ ID NO: 7699 - DNA, 30 bp, Homo sapiens
  mature of SEQ ID 5566
ttttagtttgcagagtcaaagctatgctca

SEQ ID NO: 7700 - DNA, 33 bp, Homo sapiens
  mature of SEQ ID 5566
gtttgcagagtcaaagctatgctcactctcaac

SEQ ID NO: 7701 - DNA, 22 bp, Homo sapiens
  mature of SEQ ID 4851
ccagtgaatgctttttgtggcc

SEQ ID NO: 7702 - DNA, 22 bp, Homo sapiens
  mature of SEQ ID 5471
gtgttgtaatagcctctctgtg

SEQ ID NO: 7703 - DNA, 29 bp, Homo sapiens
  mature of SEQ ID 5471
tacttgagaacaaatgctgttataatttc

SEQ ID NO: 7704 - DNA, 32 bp, Homo sapiens
  mature of SEQ ID 5471
tgagaacaaatgctgttataatttctttgggg

SEQ ID NO: 7705 - DNA, 31 bp, Homo sapiens
  mature of SEQ ID 4141
tagaatcatttccagggtaaatcacacttca

SEQ ID NO: 7706 - DNA, 34 bp, Homo sapiens
  mature of SEQ ID 4141
catttccagggtaaatcacacttcagaggcagag

SEQ ID NO: 7707 - DNA, 17 bp, Homo sapiens
  mature of SEQ ID 4141
tttgattcttctcctgg

SEQ ID NO: 7708 - DNA, 21 bp, Homo sapiens
  mature of SEQ ID 5190
tctgtgattaaagaggtggct

SEQ ID NO: 7709 - DNA, 28 bp, Homo sapiens
  mature of SEQ ID 5190
ctagattccatctccagactgtctcttg

SEQ ID NO: 7710 - DNA, 34 bp, Homo sapiens
  mature of SEQ ID 4552
gagggagcctgagaaacagctaccacattcaagg

SEQ ID NO: 7711 - DNA, 26 bp, Homo sapiens
  mature of SEQ ID 4552
ccatgggtgatggggaatcagggttc

SEQ ID NO: 7712 - DNA, 20 bp, Homo sapiens
  mature of SEQ ID 5454
ggatagggaatggcttctca

SEQ ID NO: 7713 - DNA, 19 bp, Homo sapiens
  mature of SEQ ID 5719
ttaacaacttaaaggctgg

SEQ ID NO: 7714 - DNA, 31 bp, Homo sapiens
  mature of SEQ ID 5719
ttacattaacaaccattacctattaagagtg

SEQ ID NO: 7715 - DNA, 34 bp, Homo sapiens
  mature of SEQ ID 5719
taacaaccattacctattaagagtgaaatatctg

SEQ ID NO: 7716 - DNA, 25 bp, Homo sapiens
  mature of SEQ ID 4041
acctggtccctccgcacaggagagc

SEQ ID NO: 7717 - DNA, 25 bp, Homo sapiens
  mature of SEQ ID 4041
ctgactgctcaggaggggcttatgt

SEQ ID NO: 7718 - DNA, 30 bp, Homo sapiens
  mature of SEQ ID 4805
accaaagggcaagatatctacttatgcctt

SEQ ID NO: 7719 - DNA, 33 bp, Homo sapiens
  mature of SEQ ID 4805
agggcaagatatctacttatgccttctttgtgc

SEQ ID NO: 7720 - DNA, 17 bp, Homo sapiens
  mature of SEQ ID 4805
gaagaaaaacccagtgg

SEQ ID NO: 7721 - DNA, 17 bp, Homo sapiens
  mature of SEQ ID 5315
tgaatgatgtcattctg

SEQ ID NO: 7722 - DNA, 29 bp, Homo sapiens
  mature of SEQ ID 5300
tgaacaataacattattttgttggaaaat

SEQ ID NO: 7723 - DNA, 25 bp, Homo sapiens
  mature of SEQ ID 5300
ttcttgaatcaagtcttcaaggtgc

SEQ ID NO: 7724 - DNA, 30 bp, Homo sapiens
  mature of SEQ ID 4950
atcctttctctacttaatagggaatgtctc

SEQ ID NO: 7725 - DNA, 34 bp, Homo sapiens
  mature of SEQ ID 4950
ggttctgagatccctcaagcatgaaaggaaggat

SEQ ID NO: 7726 - DNA, 28 bp, Homo sapiens
  mature of SEQ ID 4463
tctttaagccaagttctttctagacatt

SEQ ID NO: 7727 - DNA, 19 bp, Homo sapiens
  mature of SEQ ID 4463
ctagatttatggccaagaa

SEQ ID NO: 7728 - DNA, 32 bp, Homo sapiens
  mature of SEQ ID 5463
aaaggagtgagttgtgtataaggggtttaaat

SEQ ID NO: 7729 - DNA, 34 bp, Homo sapiens
  mature of SEQ ID 5463
tgagttgtgtataaggggtttaaatgctttatag

SEQ ID NO: 7730 - DNA, 22 bp, Homo sapiens
  mature of SEQ ID 5463
ctgtacagtttaagaacaaatc

SEQ ID NO: 7731 - DNA, 30 bp, Homo sapiens
  mature of SEQ ID 4935
ggaagatgccttcggggaaaatggcggcgc

SEQ ID NO: 7732 - DNA, 19 bp, Homo sapiens
  mature of SEQ ID 4935
ttgcctggaacacaggcag

SEQ ID NO: 7733 - DNA, 22 bp, Homo sapiens
  mature of SEQ ID 4554
gccctgcgcgccccgggagcgc

SEQ ID NO: 7734 - DNA, 19 bp, Homo sapiens
  mature of SEQ ID 4554
gcccgcgggctccgggtgt

SEQ ID NO: 7735 - DNA, 21 bp, Homo sapiens
  mature of SEQ ID 4990
tttggaaaacttgctataata

SEQ ID NO: 7736 - DNA, 22 bp, Homo sapiens
  mature of SEQ ID 4990
attgtataggcaggaaattaag

SEQ ID NO: 7737 - DNA, 31 bp, Homo sapiens
  mature of SEQ ID 4550
ggtatcttgttaacagtaataaccctgagcc

SEQ ID NO: 7738 - DNA, 18 bp, Homo sapiens
  mature of SEQ ID 4263
agatggatcaagttacac

SEQ ID NO: 7739 - DNA, 26 bp, Homo sapiens
  mature of SEQ ID 4673
ggagcaacatctgttctttcagaagt

SEQ ID NO: 7740 - DNA, 23 bp, Homo sapiens
  mature of SEQ ID 4487
ggagcttagtcaaaagcatctgg

SEQ ID NO: 7741 - DNA, 31 bp, Homo sapiens
  mature of SEQ ID 4487
acatcatcttcagccaagctctgagcactta

SEQ ID NO: 7742 - DNA, 29 bp, Homo sapiens
  mature of SEQ ID 4487
ttccacatcatcttcagccaagctctgag

SEQ ID NO: 7743 - DNA, 32 bp, Homo sapiens
  mature of SEQ ID 5476
ggaggaatgacaggcctcccgcagaggaggag

SEQ ID NO: 7744 - DNA, 25 bp, Homo sapiens
  mature of SEQ ID 5476
gccagctgttcccagatgtgggccg

SEQ ID NO: 7745 - DNA, 24 bp, Homo sapiens
  mature of SEQ ID 4977
aaagcaaagtagatcttgtgaaac

SEQ ID NO: 7746 - DNA, 18 bp, Homo sapiens
  mature of SEQ ID 5008
ataatgagcaagactggc

SEQ ID NO: 7747 - DNA, 27 bp, Homo sapiens
  mature of SEQ ID 5641
ttttattaacttcctattacaggaaga

SEQ ID NO: 7748 - DNA, 24 bp, Homo sapiens
  mature of SEQ ID 5641
ctctgtgaagggagtaggatgaag

SEQ ID NO: 7749 - DNA, 32 bp, Homo sapiens
  mature of SEQ ID 4569
tgtaattatgcaacacttgctttgagaaaaga

SEQ ID NO: 7750 - DNA, 31 bp, Homo sapiens
  mature of SEQ ID 4569
attcttgaaagttatgggttcgtaattgcag

SEQ ID NO: 7751 - DNA, 29 bp, Homo sapiens
  mature of SEQ ID 4569
tgtcattcttgaaagttatgggttcgtaa

SEQ ID NO: 7752 - DNA, 18 bp, Homo sapiens
  mature of SEQ ID 4260
attcacttcaatgaaatt

SEQ ID NO: 7753 - DNA, 28 bp, Homo sapiens
  mature of SEQ ID 4260
tgtgataagtggaaagtgtcaaaatgag

SEQ ID NO: 7754 - DNA, 26 bp, Homo sapiens
  mature of SEQ ID 4229
catttcgggcatggagtcctggttct

SEQ ID NO: 7755 - DNA, 19 bp, Homo sapiens
  mature of SEQ ID 4229
gtctccatggaaatgaaaa

SEQ ID NO: 7756 - DNA, 26 bp, Homo sapiens
  mature of SEQ ID 4574
ggaaattgccatgtgcagaatgactt

SEQ ID NO: 7757 - DNA, 23 bp, Homo sapiens
  mature of SEQ ID 4574
tatataatcttctaacagcagaa

SEQ ID NO: 7758 - DNA, 23 bp, Homo sapiens
  mature of SEQ ID 5168
aacctctaattttaatggaaaat

SEQ ID NO: 7759 - DNA, 17 bp, Homo sapiens
  mature of SEQ ID 5168
agattagaggttatgga

SEQ ID NO: 7760 - DNA, 34 bp, Homo sapiens
  mature of SEQ ID 5235
ggtggctgcatcccagggtcctgatgggaggagg

SEQ ID NO: 7761 - DNA, 17 bp, Homo sapiens
  mature of SEQ ID 5235
ccctggccctgtgctgc

SEQ ID NO: 7762 - DNA, 32 bp, Homo sapiens; identical to SEQ ID NO: 5981
  mature of SEQ ID 5723

SEQ ID NO: 7763 - DNA, 33 bp, Homo sapiens; identical to SEQ ID NO: 5980
  mature of SEQ ID 5723

SEQ ID NO: 7764 - DNA, 26 bp, Homo sapiens
  mature of SEQ ID 4485
tttctggacacagtggtggctttgtt

SEQ ID NO: 7765 - DNA, 31 bp, Homo sapiens
  mature of SEQ ID 4485
tgctgtaagccatacccaaatgtccctgaga

SEQ ID NO: 7766 - DNA, 27 bp, Homo sapiens
  mature of SEQ ID 5472
caggggccccatcctgctcagcctccc

SEQ ID NO: 7767 - DNA, 31 bp, Homo sapiens
  mature of SEQ ID 4595
tgatccacatatcacaaaattatactcacat

SEQ ID NO: 7768 - DNA, 29 bp, Homo sapiens
  mature of SEQ ID 4595
tttatgatccacatatcacaaaattatac

SEQ ID NO: 7769 - DNA, 32 bp, Homo sapiens
  mature of SEQ ID 4195
tttatatgcaattttagcctctgatttttcag

SEQ ID NO: 7770 - DNA, 29 bp, Homo sapiens
  mature of SEQ ID 4195
ttcttttatatgcaattttagcctctgat

SEQ ID NO: 7771 - DNA, 18 bp, Homo sapiens
  mature of SEQ ID 4399
gactccatggaaacagat

SEQ ID NO: 7772 - DNA, 27 bp, Homo sapiens
  mature of SEQ ID 4399
ctctctgtttccatggagaagtatgtc

SEQ ID NO: 7773 - DNA, 23 bp, Homo sapiens
  mature of SEQ ID 4074
ttcaaggtcattaccagggttta

SEQ ID NO: 7774 - DNA, 17 bp, Homo sapiens
  mature of SEQ ID 4129
ctgtacatgcttaaaaa

SEQ ID NO: 7775 - DNA, 34 bp, Homo sapiens
  mature of SEQ ID 4129
agatgcagattctctggtcattgagcatgtccag

SEQ ID NO: 7776 - DNA, 31 bp, Homo sapiens
  mature of SEQ ID 4129
gggtttagatgcagattctctggtcattgag

SEQ ID NO: 7777 - DNA, 17 bp, Homo sapiens
  mature of SEQ ID 4129
gcaaagagtaatgccga

SEQ ID NO: 7778 - DNA, 23 bp, Homo sapiens
  mature of SEQ ID 5082
caggtatcaaaaatgagggcagc

SEQ ID NO: 7779 - DNA, 21 bp, Homo sapiens
  mature of SEQ ID 5082
ggggcctttctgatccagttg

SEQ ID NO: 7780 - DNA, 27 bp, Homo sapiens
  mature of SEQ ID 5014
atgaagctcaagtggtttgtgtagtca

SEQ ID NO: 7781 - DNA, 28 bp, Homo sapiens
  mature of SEQ ID 5014
atgagtgtataattcccttgagcttcat

SEQ ID NO: 7782 - DNA, 32 bp, Homo sapiens
  mature of SEQ ID 5744
attggtaatgattgagttcacctctttcagaa

SEQ ID NO: 7783 - DNA, 30 bp, Homo sapiens
  mature of SEQ ID 5744
tttctattggtaatgattgagttcacctct

SEQ ID NO: 7784 - DNA, 17 bp, Homo sapiens
  mature of SEQ ID 5744
ctcttctgagtaattga

SEQ ID NO: 7785 - DNA, 18 bp, Homo sapiens
  mature of SEQ ID 4305
gtttgtacaatgtacaat

SEQ ID NO: 7786 - DNA, 34 bp, Homo sapiens
  mature of SEQ ID 4305
gttgtacagcagtataatttttcacttatttatt

SEQ ID NO: 7787 - DNA, 21 bp, Homo sapiens
  mature of SEQ ID 4237
tatggctcaaaaaatgctttg

SEQ ID NO: 7788 - DNA, 19 bp, Homo sapiens
  mature of SEQ ID 4237
gaaaatccataagctaggg

SEQ ID NO: 7789 - DNA, 31 bp, Homo sapiens
  mature of SEQ ID 5174
gataatgaaaccatttccaggcaaagaactt

SEQ ID NO: 7790 - DNA, 29 bp, Homo sapiens
  mature of SEQ ID 5174
tactgataatgaaaccatttccaggcaaa

SEQ ID NO: 7791 - DNA, 31 bp, Homo sapiens; identical to SEQ ID NO: 6738
  mature of SEQ ID 4521

SEQ ID NO: 7792 - DNA, 29 bp, Homo sapiens
  mature of SEQ ID 4521
taaccaccatcaaatgttttccacacaga

SEQ ID NO: 7793 - DNA, 24 bp, Homo sapiens
  mature of SEQ ID 5568
cagtgttctattctactctgagga

SEQ ID NO: 7794 - DNA, 20 bp, Homo sapiens
  mature of SEQ ID 5568
atgggttcatctggagttcc

SEQ ID NO: 7795 - DNA, 28 bp, Homo sapiens
  mature of SEQ ID 5255
gtgggttccaggcctgtgaggtgctggg

SEQ ID NO: 7796 - DNA, 21 bp, Homo sapiens
  mature of SEQ ID 5255
accaggccctggcggacccac

SEQ ID NO: 7797 - DNA, 31 bp, Homo sapiens
  mature of SEQ ID 5311
tgctctgtgtggtggtggtggtcacctggcc

SEQ ID NO: 7798 - DNA, 32 bp, Homo sapiens
  mature of SEQ ID 4610
atgaggataatgatatttacctcccaaggcta

SEQ ID NO: 7799 - DNA, 29 bp, Homo sapiens
  mature of SEQ ID 4610
tgaaatgaggataatgatatttacctccc

SEQ ID NO: 7800 - DNA, 17 bp, Homo sapiens
  mature of SEQ ID 4099
tttctgtaagttgaaac

SEQ ID NO: 7801 - DNA, 31 bp, Homo sapiens
  mature of SEQ ID 4099
cgttttagaaagaaatcagttggtccttttc

SEQ ID NO: 7802 - DNA, 31 bp, Homo sapiens
  mature of SEQ ID 4426
atttttcacccaagaaatttcagatttcaac

SEQ ID NO: 7803 - DNA, 33 bp, Homo sapiens
  mature of SEQ ID 4426
attctcctggataatgatgttgatggggaagtg

SEQ ID NO: 7804 - RNA, 81 nt, Homo sapiens
gggcuuucaagucacuagugguuccguuuaguagaugauugugcauuguuucaaaauggugcccuagugacuacaaagccc

SEQ ID NO: 7805 - RNA, 83 nt, Homo sapiens
  RNA of SEQ ID 77
auggcagagauauugacauagugagaaaacauugccuucaacaauagggcuuuguugacaaaacagugaaaugucuagaccau

SEQ ID NO: 7806 - RNA, 89 nt, Homo sapiens
  RNA of SEQ ID 139
gcuggcuccugcucagagugacagcacccuguggagucugcugguacugaccuaaccaccacagagccccacuggagcauggagccagc

SEQ ID NO: 7807 - RNA, 83 nt, Homo sapiens
  RNA of SEQ ID 223
agugggggcacguucaagaaugcuaaugaauuaucaguuuucuuuaagccucauuagauuucuugauagcaaaaccucccauu

SEQ ID NO: 7808 - RNA, 80 nt, Homo sapiens
  RNA of SEQ ID 328
ggcuggccaggcuccgcccccggcccucccugcgcccggccggugcgcagggaggucggaggagcgggcacugcccaccc

SEQ ID NO: 7809 - RNA, 75 nt, Homo sapiens
  RNA of SEQ ID 728
cucucuaccaccaaaauaaauucaauuacuaacuuugaguaauugcggguaauuuauuucuuggagggcagagag

SEQ ID NO: 7810 - RNA, 80 nt, Homo sapiens
  RNA of SEQ ID 832
caugugauuucugcccagugcucugaaugucaaagugaagaaauucaaugaagcacggguaaacggcgggaguaacuaug

SEQ ID NO: 7811 - RNA, 84 nt, Homo sapiens
  RNA of SEQ ID 858
gccugcuaaugguucuacugcuuuugaagguuccaggucugugcagcacagugugggaccccaggaguguggaucuguggaggc

SEQ ID NO: 7812 - RNA, 72 nt, Homo sapiens
  RNA of SEQ ID 951
acuuagaggagugacaaauuugguacuuaaaaaauauuuagguuaaaaacaacccugucacuucuacuaagu

SEQ ID NO: 7813 - RNA, 87 nt, Homo sapiens
  RNA of SEQ ID 963
cccucccaguucccauagcaacugggcuguagcagccagaacuugauugagcccagcaguggcccgacugagguggggaaaggaggg

SEQ ID NO: 7814 - RNA, 80 nt, Homo sapiens
  RNA of SEQ ID 1081
uacauaagaaauagauugcaacauguaguuacauuuuucauccuuuguaauaugcuuuuugcauccauacuucuaaugug

SEQ ID NO: 7815 - RNA, 76 nt, Homo sapiens
  RNA of SEQ ID 1173
cuuaggggugggggagcccuguuagcccuguaaauaaaguuuaacgaggugaacaauggcuggcucugucccugag

SEQ ID NO: 7816 - RNA, 88 nt, Homo sapiens
  RNA of SEQ ID 1205
agugcuuuucuguaacagucauuugacauuuaauauaccauaauuguauuauuaaauuuaaaugcauauuugcaauucuaaaagcacu

SEQ ID NO: 7817 - RNA, 90 nt, Homo sapiens
  RNA of SEQ ID 1429
gugaagaaugcaggcagguugugauuagaggugagccaguuccugauuguggguuaauaagcucugcuaauaaacugccuguagcuuuac

SEQ ID NO: 7818 - RNA, 69 nt, Homo sapiens
  RNA of SEQ ID 1611
gcaucauuagcuaacacagggaaagugaaaugcuguuaacuuuucuuuuucuucugcaagcugaugagc

SEQ ID NO: 7819 - RNA, 77 nt, Homo sapiens
  RNA of SEQ ID 1617
ccuuuugaguggaccugaaggguuuugaccuccuucaggaaaggcaaggcaaaaaccuuaaaacaguuccacugagg

SEQ ID NO: 7820 - RNA, 86 nt, Homo sapiens
  RNA of SEQ ID 1649
cauuugcuugauuaauuacugcucugaaacccuugaaaacagacauggucuguaagugguaucuguuguuuaaucgaggacagaug

SEQ ID NO: 7821 - RNA, 78 nt, Homo sapiens
  RNA of SEQ ID 1688
gagcugcacagacagcugcaauucaugggcgacgcugauugccagaaacgcuauggauuggcauggggucugcagcuc

SEQ ID NO: 7822 - DNA, 33 bp, Homo sapiens
atggcagagatattgacatagtgagaaaacatt

SEQ ID NO: 7823 - DNA, 38 bp, Homo sapiens
atggcagagatattgacatagtgagaaaacattgcctt

SEQ ID NO: 7824 - DNA, 38 bp, Mus sp.
atggcagagatattgacatagtgagaaaacattgcttt

SEQ ID NO: 7825 - DNA, 35 bp, Homo sapiens
atggcagagatattgacatagtgagaaaacattgc

SEQ ID NO: 7826 - DNA, 29 bp, Artificial
  reverse complement oligonucleotide 77-L1-1
ttttctcactatgtcaatatctctgccat

SEQ ID NO: 7827 - DNA, 31 bp, Artificial
  reverse complement oligonucleotide 77-L1-2
gcaatgttttctcactatgtcaatatctctg

SEQ ID NO: 7828 - DNA, 38 bp, Homo sapiens and Mus sp.
agggctttgttgacaaaacagtgaaatgtctagaccat

SEQ ID NO: 7829 - DNA, 31 bp, Artificial
  reverse complement oligonucleotide 77-R1-1
agacatttcactgttttgtcaacaaagccct

SEQ ID NO: 7830 - DNA, 33 bp, Artificial
  reverse complement oligonucleotide 77-R1-2
atggtctagacatttcactgttttgtcaacaaa

SEQ ID NO: 7831 - DNA, 15 bp, Artificial
  spacer added to 5' of reverse complement oligonucleotides
ttgtaatacgactca

SEQ ID NO: 7832 - DNA, 44 bp, Artificial
  reverse complement oligonucleotide 77-L1-1 with 5' added spacer
ttgtaatacgactcattttctcactatgtcaatatctctgccat

SEQ ID NO: 7833 - DNA, 46 bp, Artificial
  reverse complement oligonucleotide 77-L1-2 with 5' added spacer
ttgtaatacgactcagcaatgttttctcactatgtcaatatctctg

SEQ ID NO: 7834 - DNA, 46 bp, Artificial
  reverse complement oligonucleotide 77-R1-1 with 5' added spacer
ttgtaatacgactcaagacatttcactgttttgtcaacaaagccct

SEQ ID NO: 7835 - DNA, 48 bp, Artificial; identical to SEQ ID NO: 4005
  reverse complement oligonucleotide 77-R1-2 with 5' added spacer

The invention claimed is

1. A computer-implemented method of identifying microRNA precursor candidates in non-coding and coding regions of a genome, comprising:
   receiving at least a first and a second genome from two different species, each containing a plurality of sequences including highly repetitive DNA;
   masking a first set of highly repetitive DNA sequences in the first genome, wherein the first set includes SINE and LINE interspersed repeat sequences, but does not include at least 75% of other interspersed repeat sequences;
   masking a second set of highly repetitive DNA sequences in the second genome, wherein the second set includes SINE and LINE interspersed repeat sequences, but does not include at least 75% of the other interspersed repeat sequences;
   comparing the masked first genome to the masked second genome to determine pairs of sequences that are homologous between the two genomes;
   creating a list of microRNA precursor candidates from the homologous pairs; and
   analyzing, with a computer, the list of candidates to:
      eliminate sequences having less than 60 nucleotides; and
      identify sequences that have a stem-loop secondary structure with a 5' strand stem having from 20 to 45 nucleotides and with a 3' strand stem having from 20 to 45 nucleotides; and
      remove, from the list, sequences not having said stem-loop secondary structure, thereby identifying microRNA precursor candidates.

2. The computer-implemented method of claim 1, wherein the other interspersed repeat sequences include processed pseudogenes, retrotranscripts, DNA transposons, and retrovirus retrotransposons.

3. The computer-implemented method of claim 1, further comprising:
   creating a plurality of assemblies, each created from at least one pair of homologous sequences, wherein at least one assembly is created from a first group of at least two pairs of homologous sequences, wherein each pair of the first group has one sequence in common;
   clustering the assemblies into a plurality of clusters, wherein each assembly of a cluster shares at least one sequence with at least one other assembly of that cluster, wherein a cluster includes one or more assemblies;
   analyzing the properties of each cluster to eliminate sequences from the list of candidates.

4. The computer-implemented method of claim 3, further comprising:
   analyzing the properties of each cluster to determine new sequences from the clusters to be added to the first set and second set of sequences that are masked, further comprising:
   adding the new sequences to the first set and to the second set; and
   repeating masking with the first set and to the second set, comparing the masked genomes, creating a plurality of assemblies, and clustering the assemblies.

5. The computer-implemented method of claim 4, wherein analyzing the properties of a cluster to determine new sequences comprises:
   determining the number of sequences of a cluster; and
   if the number of sequences of a cluster is greater than a predetermined number, selecting the sequences of that cluster to be added to the first set and to the second set.

6. The computer-implemented method of claim 3, wherein at least one assembly is created from a second group of at least two pairs of homologous sequences, wherein the two sequences from the first genome of the second group overlap to form a first sequence, wherein the two sequences from the first genome of the second group overlap to form a second sequence, wherein the size variation between the first sequence and the second sequence is less than 10%, and wherein the alignment between the first sequence and the second sequence shows more than 85% sequence similarity.

7. The computer-implemented method of claim 3, wherein at least one assembly is created from a second group of at least two pairs of homologous sequences, wherein the two sequences from the first genome of the second group are consecutive and form a first sequence containing an intervening sequence, wherein the two sequences from the first genome of the second group are consecutive and form a second sequence containing an intervening sequence, wherein the size variation between the first sequence and the second sequence is less than 10%, and wherein the alignment between the first sequence and the second sequence shows more than 90% sequence similarity.

8. The computer-implemented method of claim 3, wherein analyzing the properties of a cluster includes:
if a cluster has more than a predetermined number of sequences, eliminating the sequences of that cluster from the list of candidates.

9. The computer-implemented method of claim 8, wherein the predetermined number is four.

10. The computer-implemented method of claim 8, wherein analyzing the properties of the cluster further includes:
flagging sequences that correspond to a coding gene as 'coding';
eliminating all of the sequences of the cluster if one of the sequences is flagged as 'coding'; and
eliminating the sequences of an assembly if the assembly is not identical by at least 85% within a minimal window of 60 nucleotides.

11. The computer-implemented method of claim 1, wherein analyzing comprises:
eliminating a pair of homologous sequences if a secondary structure resulting from a folding of the sequences does not satisfy each of a first set of criteria including:
a number of nucleotides in a pre-miRNA stem-loop;
a terminal hairpin being of a certain length;
a percentage similarity of the sequences between the two genomes; and
a Z score less than a specified amount; and
eliminating a pair of homologous sequences if a secondary structure resulting from a folding of the sequences does not satisfy a predetermined number of a second set of criteria including:
a minimal free energy (MFE) of less than a specified amount;
a GC content being within a certain percent range;
a base-paring number being within a certain percent range; and
perfect conservation of a sequence of a specified length along arms of the stem-loop.

12. The computer-implemented method of claim 11, wherein the predetermined number is three.

13. The computer-implemented method of claim 11, wherein the first set and the second set of criteria have the following values:
the pre-miRNA stem-loop is between 60 to 120 nucleotides;
the percentage similarity of the sequences between the two genomes is at least 85%;
at least one 17 nt-long sequence is perfectly conserved along the arms of the stem-loop;
the terminal hairpin-loop is between 4 and 15 nucleotides;
the GC content is from 30% to 51%;
the base-pairing number is between 30 and 40%;
the MFE is lower than −25 kcal/mol; and
the Z score is less than 0.06.

14. The computer-implemented method of claim 11, wherein analyzing further comprises:
when a sequence has a secondary structure satisfying the first set of criteria and a predetermined number of the second set of criteria, extracting exact positions of the 5' strand start and exact positions of the 3' strand end to make a new sequence;
folding the new sequence to from a new secondary structure; and
parsing the secondary structure of the new structure to determine if the secondary structure satisfies the first set of criteria and a predetermined number of the second set of criteria.

15. A computer-implemented method of identifying non-coding RNA candidates, comprising:
receiving at least a first and a second genome from two different species, each containing a plurality of sequences including highly repetitive DNA;
masking a first set of highly repetitive DNA sequences in the first genome, wherein the first set includes SINE and LINE interspersed repeat sequences, but does not include at least 75% of other interspersed repeat sequences;
masking a second set of highly repetitive DNA sequences in the second genome, wherein the second set includes SINE and LINE interspersed repeat sequences, but does not include at least 75% of the other interspersed repeat sequences;
comparing the masked first genome to the masked second genome to determine pairs of sequences that are homologous between the two genomes;
creating a list of non-coding RNA candidates from the homologous pairs;
creating a plurality of assemblies, each created from at least one pair of homologous sequences, wherein at least one assembly is created from a first group of at least two pairs of homologous sequences, wherein each pair of the first group has one sequence in common;
clustering the assemblies into a plurality of clusters, wherein each assembly of a cluster shares at least one sequence with at least one other assembly of that cluster, wherein a cluster includes one or more assemblies;
analyzing the properties of each cluster to eliminate sequences from the list of candidates;
analyzing, with a computer, the list of candidates to:
eliminate sequences having less than 60 nucleotides; and
identify sequences that have a stem-loop secondary structure with a 5' strand stem having from 20 to 45 nucleotides and with a 3' strand stem having from 20 to 45 nucleotides; and
remove, from the list, sequences not having said stem-loop secondary structure;
eliminating a pair of homologous sequences if the secondary structure does not satisfy each of a first set of criteria; and
eliminating a pair of homologous sequences if the secondary structure does not satisfy a predetermined number of a second set of criteria, thereby identifying microRNA precursor candidates.

16. A non-transitory computer readable medium storing instructions directing a computer to perform a method of identifying microRNA precursor candidates in non-coding and coding regions of a genome, the instructions comprising:

receiving at least a first and a second genome from two different species, each containing a plurality of sequences including highly repetitive DNA;

masking a first set of highly repetitive DNA sequences in the first genome, wherein the first set includes SINE and LINE interspersed repeat sequences, but does not include at least 75% of other interspersed repeat sequences;

masking a second set of highly repetitive DNA sequences in the second genome, wherein the second set includes SINE and LINE interspersed repeat sequences, but does not include at least 75% of the other interspersed repeat sequences;

comparing the masked first genome to the masked second genome to determine pairs of sequences that are homologous between the two genomes;

creating a list of microRNA precursor candidates from the homologous pairs; and analyzing the list of candidates to:
eliminate sequences having less than 60 nucleotides; and
identify sequences that have a stem-loop secondary structure with a 5' strand stem having from 20 to 45 nucleotides and with a 3' strand stem having from 20 to 45 nucleotides; and
remove, from the list, sequences not having said stem-loop secondary structure, thereby identifying microRNA precursor candidates.

17. The computer readable medium of claim 16, wherein the other interspersed repeat sequences include processed pseudogenes, retrotranscripts, DNA transposons, and retrovirus retrotransposons.

18. The computer readable medium of claim 16, further comprising:
creating a plurality of assemblies, each created from at least one pair of homologous sequences, wherein at least one assembly is created from a first group of at least two pairs of homologous sequences, wherein each pair of the first group has one sequence in common;
clustering the assemblies into a plurality of clusters, wherein each assembly of a cluster shares at least one sequence with at least one other assembly of that cluster, wherein a cluster includes one or more assemblies;
analyzing the properties of each cluster to eliminate sequences from the list of candidates.

19. The computer readable medium of claim 18, further comprising:
analyzing the properties of each cluster to determine new sequences from the clusters to be added to the first set and second set of sequences that are masked, further comprising:
adding the new sequences to the first set and to the second set; and
repeating masking with the first set and to the second set, comparing the masked genomes, creating a plurality of assemblies, and clustering the assemblies.

20. The computer readable medium of claim 19, wherein analyzing the properties of a cluster to determine new sequences comprises:
determining the number of sequences of a cluster; and
if the number of sequences of a cluster is greater than a predetermined number, selecting the sequences of that cluster to be added to the first set and to the second set.

21. The computer readable medium of claim 18, wherein at least one assembly is created from a second group of at least two pairs of homologous sequences, wherein the two sequences from the first genome of the second group overlap to form a first sequence, wherein the two sequences from the first genome of the second group overlap to form a second sequence, wherein the size variation between the first sequence and the second sequence is less than 10%, and wherein the alignment between the first sequence and the second sequence shows more than 85% sequence similarity.

22. The computer readable medium of claim 18, wherein at least one assembly is created from a second group of at least two pairs of homologous sequences, wherein the two sequences from the first genome of the second group are consecutive and form a first sequence containing an intervening sequence, wherein the two sequences from the first genome of the second group are consecutive and form a second sequence containing an intervening sequence, wherein the size variation between the first sequence and the second sequence is less than 10%, and wherein the alignment between the first sequence and the second sequence shows more than 90% sequence similarity.

23. The computer readable medium of claim 18, wherein analyzing the properties of a cluster includes:
if a cluster has more than a predetermined number of sequences, eliminating the sequences of that cluster from the list of candidates.

24. The computer readable medium of claim 23, wherein the predetermined number is four.

25. The computer readable medium of claim 23, wherein analyzing the properties of the cluster further includes:
flagging sequences that correspond to a coding gene as 'coding';
eliminating all of the sequences of the cluster if one of the sequences is flagged as 'coding'; and
eliminating the sequences of an assembly if the assembly is not identical by at least 85% within a minimal window of 60 nucleotides.

26. The computer readable medium of claim 16, wherein analyzing comprises:
eliminating a pair of homologous sequences if a secondary structure resulting from a folding of the sequences does not satisfy each of a first set of criteria including:
a number of nucleotides in a pre-miRNA stem-loop;
a terminal hairpin being of a certain length;
a percentage similarity of the sequences between the two genomes; and
a Z score less than a specified amount; and
eliminating a pair of homologous sequences if a secondary structure resulting from a folding of the sequences does not satisfy a predetermined number of a second set of criteria including:
a minimal free energy (MFE) of less than a specified amount;
a GC content being within a certain percent range;
a base-paring number being within a certain percent range; and
perfect conservation of a sequence of a specified length along arms of the stem-loop.

27. The computer readable medium of claim 26, wherein the predetermined number is three.

28. The computer readable medium of claim 26, wherein the first set and the second set of criteria have the following values:
the pre-miRNA stem-loop is between 60 to 120 nucleotides;
the percentage similarity of the sequences between the two genomes is at least 85%;
at least one 17 nt-long sequence is perfectly conserved along the arms of the stem-loop;
the terminal hairpin-loop is between 4 and 15 nucleotides;

the GC content is from 30% to 51%;
the base-pairing number is between 30 and 40%;
the MFE is lower than −25 kcal/mol; and
the Z score is less than 0.06.

29. The computer readable medium of claim 26, wherein analyzing further comprises:
when a sequence has a secondary structure satisfying the first set of criteria and a predetermined number of the second set of criteria, extracting exact positions of the 5' strand start and exact positions of the 3' strand end to make a new sequence;
folding the new sequence to from a new secondary structure; and
parsing the secondary structure of the new structure to determine if the secondary structure satisfies the first set of criteria and a predetermined number of the second set of criteria.

* * * * *